US009200275B2

(12) United States Patent
Linsley et al.

(10) Patent No.: US 9,200,275 B2
(45) Date of Patent: Dec. 1, 2015

(54) METHODS AND COMPOSITIONS FOR REGULATING CELL CYCLE PROGRESSION

(75) Inventors: Peter S. Linsley, Encinitas, CA (US); Janell Schelter, Bellevue, WA (US); Julja Burchard, San Francisco, CA (US); Lee Lim, San Francisco, CA (US); Miho Kibukawa, Bothell, WA (US)

(73) Assignee: Merck Sharp & Dohme Corp., Rahway, NJ (US)

( * ) Notice: Subject to any disclaimer, the term of this patent is extended or adjusted under 35 U.S.C. 154(b) by 1148 days.

(21) Appl. No.: 12/304,968

(22) PCT Filed: Jun. 14, 2007

(86) PCT No.: PCT/US2007/071239
§ 371 (c)(1),
(2), (4) Date: Sep. 8, 2009

(87) PCT Pub. No.: WO2007/147067
PCT Pub. Date: Dec. 21, 2007

(65) Prior Publication Data
US 2010/0035966 A1    Feb. 11, 2010

Related U.S. Application Data

(60) Provisional application No. 60/813,827, filed on Jun. 14, 2006.

(51) Int. Cl.
*C12N 15/113* (2010.01)
*C12N 15/11* (2006.01)

(52) U.S. Cl.
CPC .......... *C12N 15/111* (2013.01); *C12N 2310/14* (2013.01); *C12N 2320/12* (2013.01); *C12N 2330/10* (2013.01); *C12N 2330/31* (2013.01)

(58) Field of Classification Search
CPC .......................... C12N 15/111; C12N 2310/14
See application file for complete search history.

(56) References Cited

U.S. PATENT DOCUMENTS

| | | | |
|---|---|---|---|
| 6,506,559 B1 * | 1/2003 | Fire et al. ...................... | 435/6.16 |
| 6,573,099 B2 | 6/2003 | Graham | |
| 2003/0113787 A1 * | 6/2003 | Bertin ................................ | 435/6 |
| 2003/0198627 A1 | 10/2003 | Arts | |
| 2004/0087523 A1 * | 5/2004 | Freier et al. ...................... | 514/44 |
| 2004/0152112 A1 | 8/2004 | Croce | |
| 2004/0259247 A1 * | 12/2004 | Tuschl et al. ................... | 435/375 |
| 2005/0020521 A1 | 1/2005 | Rana | |
| 2005/0059005 A1 * | 3/2005 | Tuschl et al. ....................... | 435/6 |
| 2005/0059019 A1 | 3/2005 | Bulow | |
| 2005/0064470 A1 | 3/2005 | Rana | |
| 2005/0214851 A1 | 9/2005 | Arts | |
| 2005/0221293 A1 | 10/2005 | Tuschl | |
| 2005/0222399 A1 | 10/2005 | Bentwich | |
| 2005/0223427 A1 | 10/2005 | Leake | |
| 2006/0019256 A1 | 1/2006 | Clarke | |
| 2006/0078902 A1 | 4/2006 | Bunting | |
| 2006/0094676 A1 | 5/2006 | Lahav | |
| 2006/0100791 A1 | 5/2006 | Cheng | |

FOREIGN PATENT DOCUMENTS

| | | |
|---|---|---|
| WO | 03/070918 A2 | 8/2003 |
| WO | 2005/042708 A2 | 5/2005 |
| WO | 2005/078097 A2 | 8/2005 |
| WO | 2006/006948 A2 | 1/2006 |

OTHER PUBLICATIONS

Fry et al. (Molecular Cancer Therapeutics, 2004; 3:1427-1438).*
Brennecke, J., et al., "Principles of MicroRNA—Target Recognition," PLoS Biology 3(3):e85:0404-0418, Mar. 2005.
Brown, B.D., et al., "Endogenous MicroRNA Regulation Suppresses Transgene Expression in Hematopoietic Lineages and Enables Stable Gene Transfer," Nature Medicine: Advance Online Publication, Apr. 2006, pp. 1-7.
Calin, G.A., et al., "A MicroRNA Signature Associated With Prognosis and Progression in Chronic Lymphocytic Leukemia," New England Journal of Medicine 353(17):1793-1801, Oct. 2005.
Cummins, J.M., et al., "The Colorectal MicroRNAome," Proceedings of the National Academy of Sciences of the United States of America (PNAS) 103(10):3687-3692, Mar. 2006.
Esquela-Kerscher, A., and F.J. Slack, "Oncomirs—MicroRNAs With a Role in Cancer," Nature Reviews: Cancer 6(4):259-269, Apr. 2006.
He, L., et al., "A MicroRNA Polycistron as a Potential Human Oncogene," Nature 435(7043):828-833, Jun. 2005.
Holen, T., et al., "Positional Effects of Short Interfering RNAs Targeting the Human Coagulation Trigger Tissue Factor," Nucleic Acids Research 30(8):1757-1766, Apr. 2002.
Holen, T., et al., "Similar Behaviour of Single-Strand and Double-Strand siRNAs Suggests They Act Through a Common RNAi Pathway," Nucleic Acids Research 31(9):2401-2407, May 2003.
Jackson, A.L., et al., "Widespread siRNA 'Off-Target' Transcript Silencing Mediated by Seed Region Sequence Complementarity," RNA 12(7):1-9, May 2006 (online publication at <www.rnajournal.org>).

(Continued)

*Primary Examiner* — Jon E Angell
(74) *Attorney, Agent, or Firm* — Christensen O'Connor Johnson Kindness PLLC

(57) ABSTRACT

In one aspect, a method is provided of inhibiting proliferation of a mammalian cell comprising introducing into said cell an effective amount of at least one at least one small interfering RNA agent (iRNA), wherein said iRNA comprises a nucleotide sequence of at least 15 nucleotides, wherein the nucleotide sequence comprises a seed region consisting of nucleotide positions 1 to 12, wherein position 1 represents the 5' end of the iRNA nucleotide sequence and wherein said seed region comprises a nucleotide sequence of at least six contiguous nucleotides that is complementary to six contiguous nucleotides within positions 1 to 12 of a nucleotide sequence, wherein position 1 represents the 5"end of the nucleotide sequence, wherein the nucleotide sequence is selected from the group consisting of SEQ ID NO: 1, SEQ ID NO:2, SEQ ID NO:3, SEQ ID NO:4, SEQ ID NO:5, SEQ ID NO:6, SEQ ID NO:7 and SEQ ID NO:8. In some embodiments, the method comprises introducing at least one iRNA that inhibits the expression of at least one miR-16 responsive gene selected from TABLE 5 into the mammalian cell.

23 Claims, 10 Drawing Sheets

(56) References Cited

OTHER PUBLICATIONS

Lu, J., et al., "MicroRNA Expression Profiles Classify Human Cancers," Nature 435(7043):834-838, Jun. 2005.
Petit-Zeman, S., "MicroRNAs Hit the Big Time," Nature Reviews: Drug Discovery 5(1):5, Jan. 2006.
Volinia, S., et al., "A MicroRNA Expression Signature of Human Solid Tumors Defines Cancer Gene Targets," Proceedings of the National Academy of Sciences of the United States of America (PNAS) 103(7):2257-2261, Feb. 2006.
Yanaihara, N., et al., "Unique MicroRNA Molecular Profiles in Lung Cancer Diagnosis and Prognosis," Cancer Cell 9(3):189-198, Mar. 2006.
Ambros, V., et al., "A Uniform System for MicroRNA Annotation," RNA 9(3):277-279, Mar. 2003.
Bartel, D.P., "MicroRNAs: Genomics, Biogenesis, Mechanism, and Function," Cell 116(2):281-297, Jan. 2004.
Bentwich, I., "Prediction and Validation of MicroRNAs and Their Targets," FEBS Letters 579(26):5904-5910, Sep. 2005.
Cai, X., et al., "Kaposi's Sarcoma-Associated Herpesvirus Expresses an Array of Viral MicroRNAs in Latently Infected Cells," PNAS 102(15):5570-5575, Apr. 2005.
Calin, G.A., et al., "Frequent Deletions and Down-Regulation of MicroRNA Genes miR15 and miR16 at 13q14 in Chronic Lymphocytic Leukemia," PNAS 99(24):15524-15529, Nov. 2002.
Griffiths-Jones, S., "The MicroRNA Registry," Nucleic Acids Research 32(Suppl. 1):D109-D111, Jan. 2004.
Griffiths-Jones, S., et al., "miRBase: MicroRNA Sequences, Targets and Gene Nomenclature," Nucleic Acids Research 34(Suppl. 1):D140-D144, Jan. 2006.
Hannon, G.J., "RNA Interference," Nature 418(6894):244-251, Jul. 2002.
Hutvágner, G., et al., "Sequence-Specific Inhibition of Small RNA Function," PLoS Biology 2(4):0465-0475, Apr. 2004.
Jackson, A.L., et al., "Expression Profiling Reveals Off-Target Gene Regulation by RNAi," Nature Biotechnology 21(6):635-637, Jun. 2003.
John, B., et al., "Human MicroRNA Targets," PLoS Biol 2(11):1862-1879, Nov. 2004.
Krek, A., et al., "Combinatorial MicroRNA Target Predictions," Nature Genetics 37(5):495-500, May 2005.
Lagos-Quintana, M., et al., "Identification of Tissue-Specific MicroRNAs From Mouse," Current Biology 12(9):735-739, Apr. 2002.
Lewis, B.P., et al., "Conserved Seed Pairing, Often Flanked by Adenosines, Indicates That Thousands of Human Genes Are MicroRNA Targets," Cell 120(1):15-20, Jan. 2005.
Lim, L.P., et al., "Microarray Analysis Shows That Some MicroRNAs Downregulate Large Numbers of Target mRNAs," Nature 433(7027):769-773, Feb. 2005.
Lim, L.P., et al., "Vertebrate MicroRNA Genes," Science 299(5612):1540, Mar. 2003.

Liu, C.-G., et al., "An Oligonucleotide Microchip for Genome-Wide MicroRNA Profiling in Human and Mouse Tissues," PNAS 101(26):9740-9744, Jun. 2004.
Martinez, J., et al., "Single-Stranded Antisense siRNAs Guide Target RNA Cleavage in RNAi," Cell 110(5):563-574, Sep. 2002.
McCaffrey, A.P., et al., "RNA Interference in Adult Mice," Nature 418(6893):38-39, Jul. 2002.
Nucleic Acid Sequence Accession No. AK000660, "*Homo sapiens* cDNA FLJ20653 fis, Clone KAT01739," as modified In GenBank on Sep. 13, 2003, NCBI Sequence Viewer, <http://www.ncbi.nlm.nih.gov> [retrieved Feb. 11, 2011], 2 pages.
Nucleic Acid Sequence Accession No. NM_001256, "*Homo sapiens* Cell Division Cycle 27 Homolog (*S. cerevisiae*) (CDC27), mRNA," as modified in GenBank on May 7, 2006, NCBI Sequence Viewer, <http://www.ncbi.nlm.nih.gov> [retrieved Feb. 11, 2011], 6 pages.
O'Donnell, K.A., et al., "c-Myc-Regulated MicroRNAs Modulate E2F1 Expression," Nature 435(7043):839-843, Jun. 2005.
Olsen, P.R., and V. Ambros, "The lin-4 Regulatory RNA Controls Developmental Timing in *Caenorhabditis elegans* by Blocking LIN-14 Protein Synthesis After the Initiation of Translation," Developmental Biology 216(2):671-680, Dec. 1999.
Ørom, U.A., et al., "LNA-Modified Oligonucleotides Mediate Specific Inhibition of MicroRNA Function," Gene 372:137-141, May 2006.
Pasquinelli, A.E., and G. Ruvkun, "Control of Developmental Timing by MicroRNAs and Their Targets," Annual Review of Cell and Developmental Biology 18:495-513, Nov. 2002.
Pulukuri, S.M., et al., "RNA Interference-Directed Knockdown of Urokinase Plasminogen Activator and Urokinase Plasminogen Activator Receptor Inhibits Prostate Cancer Cell Invasion, Survival, and Tumorigenicity in Vivo," Journal of Biological Chemistry 280(43):36529-36540, Oct. 2005.
Schwarz, D.S., et al., "Evidence That siRNAs Function as Guides, Not Primers, in the *Drosophila* and Human RNAi Pathways," Molecular Cell 10(3):537-568, Sep. 2002.
Sempere, L.F., et al., "Expression Profiling of Mammalian MicroRNAs Uncovers a Subset of Brain Expressed MicroRNAs With Possible Roles in Murine and Human Neuronal Differentiation," Genome Biology 5(3):R13.1-R13.11, Feb. 2004.
Silva, J.M., et al., "Second-Generation shRNA Libraries Covering the Mouse and Human Genomes," Nature Genetics 37(11):1281-1288, Nov. 2005.
Soutschek, J., et al., "Therapeutic Silencing of an Endogenous Gene by Systemic Administration of Modified siRNAs," Nature 432(7014):173-178, Nov. 2004.
Verma, S.C., and E.S. Robertson, "Molecular Biology and Pathogenesis of Kaposi Sarcoma-Associated Herpesvirus," FEMS Microbiology Letters 222(2):155-163, May 2003.
Xie, X., et al., "Systematic Discovery of Regulatory Motifs in Human Promoters and 3' UTRs by Comparison of Several Mammals," Nature 434(7031):338-345, Mar. 2005.
Yang, D., et al., "Short RNA Duplexes Produced by Hydrolysis With *Escherichia coli* RNase III Mediate Effective RNA Interference in Mammalian Cells," PNAS 99(15):9942-9947, Jul. 2002.

* cited by examiner

| | SEED | SEQ. ID. NO: |
|---|---|---|
| hsa-miR-15a | -UAGCAGCACAUAAU-GGUUUGUG- | 28 |
| hsa-miR-15b | -UAGCAGCACAUCAU-GGUUUACA- | 2 |
| hsa-miR-16 | -UAGCAGCACGUAA-AUAUUGGCG- | 3 |
| hsa-miR-103 | -AGCAGCAUUGUACAGGGCUAUGA | 4 |
| hsa-miR-107 | --AGCAGCAUUGUACAGGGCUAUCA | 5 |
| hsa-miR-195 | -UAGCAGCACAGAA-AUAUUGGC-- | 6 |
| kshv-miR-K12-6-5p | CCAGCAGCACCCUAAUCCAUCGG--- | 7 |
| miR-17-5p | CAAAGUGCUUACAGUGCAGGUAGU | 9 |
| miR-20a | UAAAGUGCUUAUAGUGCAGGUAG- | 10 |
| miR-106b | UAAAGUGCUGACAGUGCAGAU-- | 11 |
| miR-141 | UAACACUGUCUGGUAAAGAUGG | 12 |
| miR-200a | UAACACUGUCUGGUAACGAUGU | 13 |
| miR-192 | CUGACCUAUGAAUUGACAGCC | 14 |
| miR-215 | AUGACCUAUGAAUUGACAGAC | 15 |

*Fig.2.*

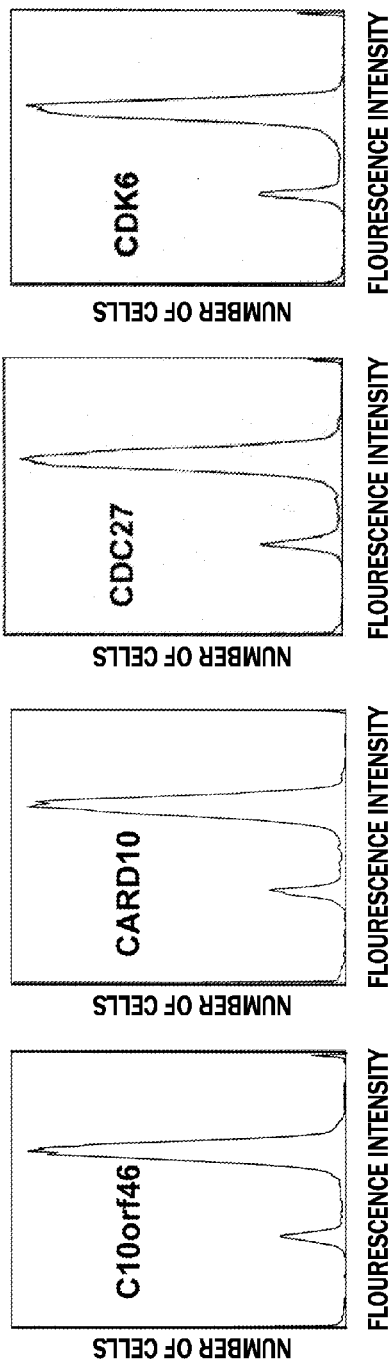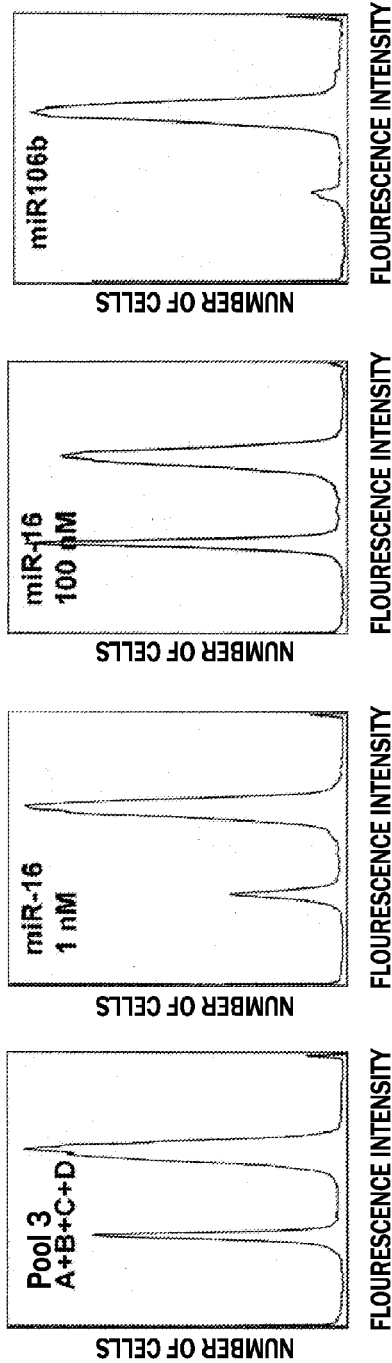
Fig. 8A. C10orf46
Fig. 8B. CARD10
Fig. 8C. CDC27
Fig. 8D. CDK6
Fig. 8E. Pool 3 A+B+C+D
Fig. 8F. miR-16 1 nM
Fig. 8G. miR-16 100 pM
Fig. 8H. miR106b

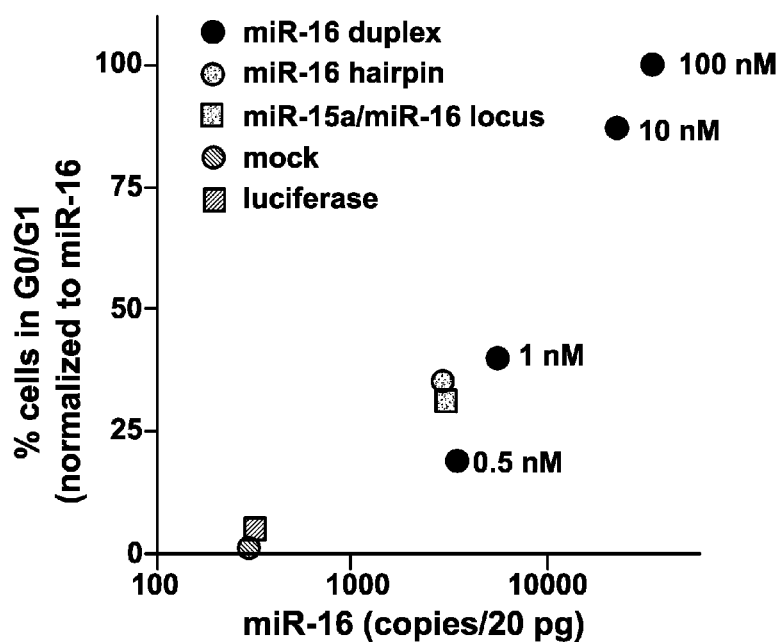
*Fig. 9A.*
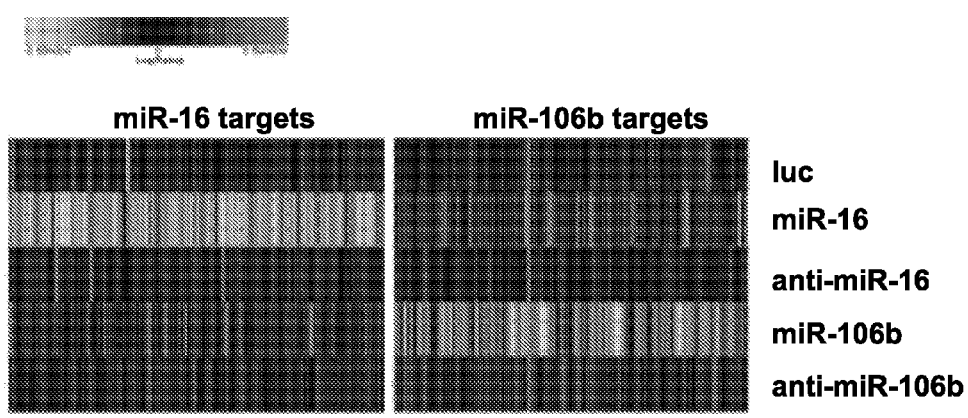
*Fig. 9B.*     *Fig. 9C.*

METHODS AND COMPOSITIONS FOR REGULATING CELL CYCLE PROGRESSION

FIELD OF THE INVENTION

This invention generally relates to methods for identifying a subset of microRNA responsive genes that share at least one phenotype, and to methods and compositions for regulating cell cycle progression.

BACKGROUND

Many genes are related via common regulation, common functional molecular mechanisms, and common pathways. Understanding the relationship between genes is important for biological research and has extensive practical application in drug development and diagnostics.

MicroRNAs are a recently identified class of regulatory RNAs that target specific mRNAs for degradation or inhibition of translation, resulting in a decrease of the protein encoded by the target mRNA. Current estimates are that 30% or more of human mRNAs are regulated by miRNAs (Lewis et al., *Cell* 120:15-20 (2005). Studies investigating expression profiles of various miRNAs in normal and cancer cells reveals that miRNA expression patterns may have clinical relevance. (See, e.g., Yanaihara, N. et al., *Cancer Cell* 9:189-198, 2006). Application of various bioinformatics approaches have revealed that a single miRNA might bind to as many as 200 gene targets and these targets are often diverse in function, including, for example, transcription factors, secreted factors, receptors and transporters (see, e.g., Esquela-Kerscher and Slack, *Nature Reviews* 6:259-269 (2006); Baretl, D. P. et al., *Nat Rev Genet* 5(5):396-400 (2004)). Therefore, the deletion or overexpression of a particular miRNA is likely to be pleotropic.

To date, over 200 microRNAs have been described in humans, however, the current state of knowledge regarding microRNA targets and the determination of microRNA functions is incomplete. Although thousands of miRNA targets have been predicted using computational methods, relatively few predications have been experimentally validated. Computational methods are not optimal for predicting miRNA target sites. Bioinformatics approaches generally rely heavily on the detection of seed region (the encompasses the first 1-12 bases of the mature miRNA sequence) complementary motifs that are conserved in the 3' UTR sequences of genes across divergent species (see, e.g., John, B. et al., *PloS Biol* 2(11): e363, 2004). Therefore, such methods are not predictive for microRNA targets sites that are not conserved across species, or for identifying target sites that are not perfectly matched with seed regions. Moreover, target prediction using different computational methods often do not agree. Since relatively few predicted microRNA: target interactions have been experimentally confirmed, it is difficult to know how accurate such predictions are. Available methods for validation are laborious and not easily amenable to high-throughput methodologies (see e.g., Bentwich, I., *FEBS Lett* 579:5904-5910 (2005)).

It is important to assign functions to miRNAs and to accurately identify miRNA responsive targets. Since a single miRNA can regulate hundreds of targets, understanding of biological pathways regulated by microRNAs is not obiouvs from examination of their targets. As functions are assigned to miRNAs, it is also important to determine which of their target(s) are responsible for a phenotype. It is also currently unknown whether the numerous miRNA responsive targets act individually or in concert.

SUMMARY

In accordance with the foregoing, in one aspect, the present invention provides a method for identifying a subset of genes that are responsive to a selected microRNA species and share at least one phenotype, the method comprising: a) modulating the level of at least one microRNA species in a cell type of interest; b) measuring the level of expression of each member of a plurality of genes in the modulated cells to yield a plurality of expression values; c) measuring the level of expression of each member of the same plurality of genes in a reference cell type that is not modulated to yield a plurality of reference expression values; d) comparing the plurality of expression values from the modulated cells with the plurality of reference expression values to identify a set of genes that are responsive to the microRNA species, each identified gene having an expression value that is statistically different from the corresponding reference value; e) identifying transcripts within the set of genes that contain at least one microRNA responsive target sequence corresponding to the modulated microRNA species; f) modulating the level of expression of a plurality of members of the set of genes that are responsive to the microRNA species and that contain at least one microRNA responsive target sequence in the cell type of interest with a plurality of gene-specific agents; and g) comparing the cells modulated in step (a) and the cells modulated in step (f) for the presence of at least one shared phenotype to identify a subset of genes that are responsive to the selected microRNA species and exhibit a shared phenotype.

In another aspect, the present invention provides a method of inhibiting proliferation of a mammalian cell comprising introducing into said cell an effective amount of at least one at least one small interfering RNA agent (iRNA), wherein said iRNA comprises a nucleotide sequence of at least 15 nucleotides, wherein the nucleotide sequence comprises a seed region consisting of nucleotide positions 1 to 12, wherein position 1 represents the 5' end of the iRNA nucleotide sequence and wherein said seed region comprises a nucleotide seqeuence of at least six contiguous nucleotides that is complementary to six contiguous nucleotides within positions 1 to 12 of a nucleotide sequence, wherein position 1 represents the 5' end of the nucleotide sequence, wherein the nucleotide sequence is selected from the group consisting of SEQ ID NO: 1, SEQ ID NO:2, SEQ ID NO:3, SEQ ID NO:4, SEQ ID NO:5, SEQ ID NO:6, SEQ ID NO:7 and SEQ ID NO:8. In some embodiments, the method comprises introducing at least one iRNA that inhibits the expression of at least one miR-16 responsive gene selected from TABLE 5 into the mammalian cell.

In some embodiments, the at least one miR-16 response gene is selected from the group consisting of ATG9A, ATXN7L3, C10orf46, IPPK, C9orf42, C9orf91, CARD10, CBX6, CDC27, CDK6, COX10, H2AFX, KIAA0317, MFN2, PHF17, PPP1R11, RAB11FIP2, and SRPR.

In another aspect, the present invention provides a composition comprising a combination of gene-specific inhibitors directed to at least two miR-16 responsive target genes selected from TABLE 5. In some embodiments, the composition comprises a combination of selective inhibitors directed to at least two miR-16 responsive target genes selected from the group consisting of: ATG9A, ATXN7L3, C10orf46, IPPK, C9orf42, C9orf91, CARD10, CBX6, CDC27, CDK6, COX10, H2AFX, KIAA0317, MFN2, PHF17, PPP1R11, RAB11FIP2, and SRPR. In further embodiments, the composition comprises a combination of selective inhibitors directed to at least two miR-16 responsive target genes selected from the group consisting of CARD10, CDC27, CDK6, and C10orf46.

In another aspect, the present invention provides a composition comprising a at least one gene-specific inhibitor directed to at least one miR-16 responsive target gene selected from TABLE 6.

In yet another aspect, the present invention provides an isolated dsRNA molecule comprising one nucleotide strand that is substantially identical to a sequence selected from the group consisting of SEQ ID NO:236 to SEQ ID NO:361.

The methods of the invention are useful, for example, for identifying a subset of microRNA responsive genes that are associated with a common biological pathway. The compositions comprising gene-specific agents directed to the identified microRNA responsive genes are useful, for example, for modulating one or more biological pathways.

DESCRIPTION OF THE DRAWINGS

The foregoing aspects and many of the attendant advantages of this invention will become more readily appreciated as the same become better understood by reference to the following detailed description, when taken in conjunction with the accompanying drawings, wherein:

FIG. 2 illustrates an exemplary set of microRNA responsive target sequences having related seed regions;

FIG. 7A illustrates the percentage of HCT116Dicer$^{ex5}$ cells accumulated in G0/G1 after transfection with miR-16;

FIG. 7B illustrates the percentage of HCT116Dicer$^{ex5}$ cells accumulated in G0/G1 after transfection with miR-106b;

FIG. 7C illustrates the percentage of HCT116Dicer$^{ex5}$ cells accumulated in G0/G1 after transfection with an siRNA pool directed to C10orf46;

FIG. 7D illustrates the percentage of HCT116Dicer$^{ex5}$ cells accumulated in G0/G1 after transfection with an siRNA pool directed to CARD 10;

FIG. 7E illustrates the percentage of HCT116Dicer$^{ex5}$ cells accumulated in G0/G1 after transfection with an siRNA pool directed to CDC27;

FIGS. 8A-H graphically illustrates the cooperative cell cycle regulation by miR-16 down regulated targets, as evidenced by the additive effect on G0/G1 cell accumulation in cells transfected with a pool of siRNAs directed to selected miR-16 downregulated gene targets as compared with cells transfected with siRNAs directed to single miR-16 downregulated gene targets, as described in EXAMPLE 7.

FIG. 8A illustrates the percentage of HCT116Dicer$^{ex5}$ cells accumulated in G0/G1 after transfection with an siRNA directed to CD10orf46;

FIG. 8B illustrates the percentage of HCT116Dicer$^{ex5}$ cells accumulated in G0/G1 after transfection with an siRNA directed to CARD 10;

FIG. 8C illustrates the percentage of HCT116Dicer$^{ex5}$ cells accumulated in G0/G1 after transfection with an siRNA directed to CDC27;

FIG. 8D illustrates the percentage of HCT116Dicer$^{ex5}$ cells accumulated in G0/G1 after transfection with an siRNA directed to CDK6;

FIG. 8E illustrates the percentage of HCT116Dicer$^{ex5}$ cells accumulated in G0/G1 after transfection with an siRNA pool (A+B+C+D) directed to CD10orf46, CARD 10, CDC27 and CDK6;

FIG. 8F illustrates the percentage of HCT116Dicer$^{ex5}$ cells accumulated in G0/G1 after transfection with miR-16 (1 nM);

FIG. 8G illustrates the percentage of HCT116Dicer$^{ex5}$ cells accumulated in G0/G1 after transfection with miR-16 (100 nM);

FIG. 8H illustrates the percentage of HCT116Dicer$^{ex5}$ cells accumulated in G0/G1 after transfection with miR-106b;

FIG. 9A graphically illustrates the percentage of HCT116Dicer$^{ex5}$ cells accumulated in G0/G1 after transfection increasing concentrations of the miR-16 duplex (0.5, 1, 10 and 100 nM) or plasmids carrying miR-16 expressed as an shRNA (miR-16 hairpin, or from its endogenous locus on chromosome 13 (miR-16 locus), as described in EXAMPLE 8;

FIG. 9B is a heatmap representation of gene expression of miR-16 targets in HeLa cells after transfection with luciferase, miR-16, anti-miR-16, miR-106b or anti-miR106b duplexes, as described in EXAMPLE 8;

FIG. 9C is a heatmap representation of gene expression of miR-106b targets in HeLa cells after transfection with luciferase, miR-16, anti-miR-16, miR-106b or anti-miR106b duplexes, as described in EXAMPLE 8.

DETAILED DESCRIPTION

Figure 1:
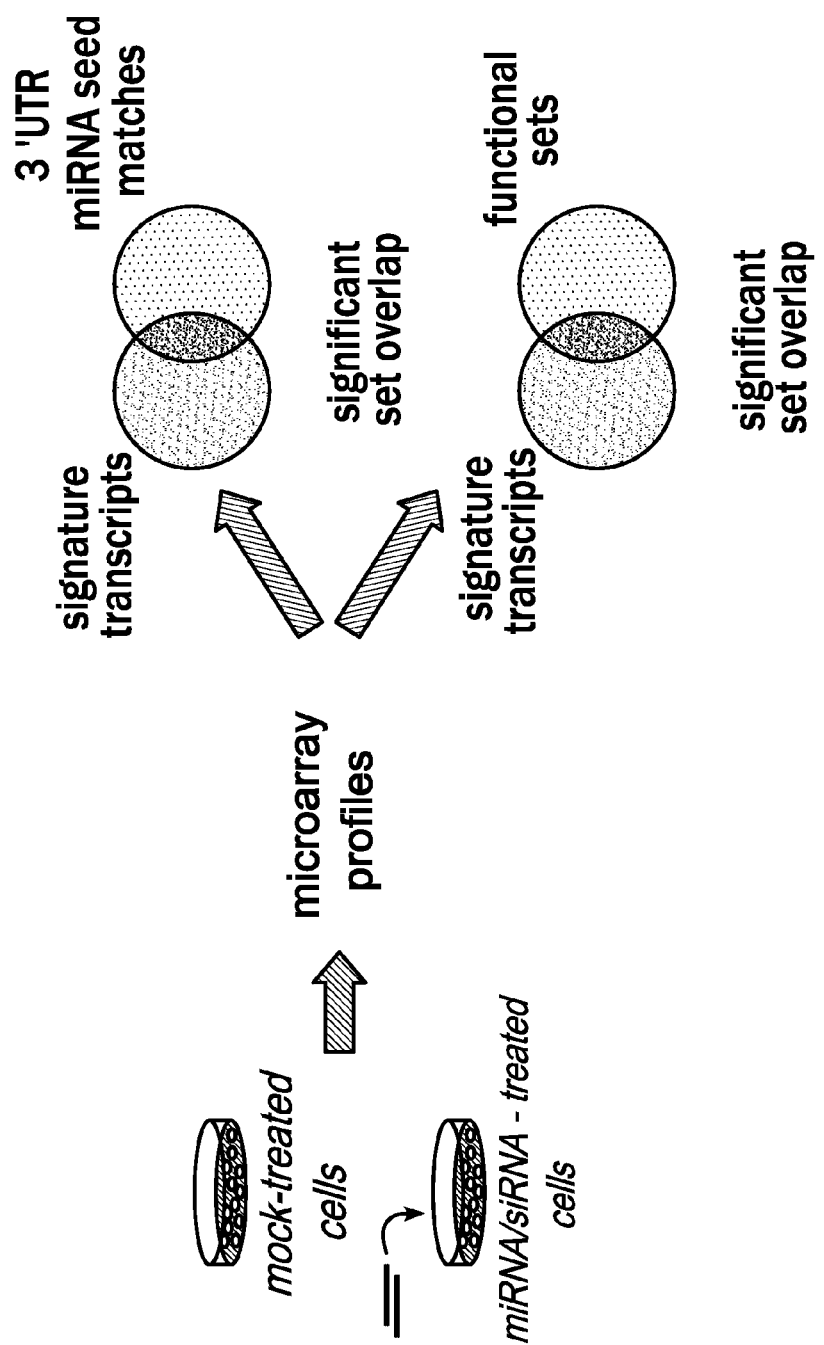
FIG. 1 illustrates an exemplary method of identifying a subset of genes that are responsive to a selected microRNA species and share at least one phenotype, in accordance with an embodiment of the present invention.

Unless specifically defined herein, all terms used herein have the same meaning as they would to one skilled in the art of the present invention. Practitioners are particularly directed to Sambrook et al. (1989), *Molecular Cloning: A Laboratory Manual*, 2$^{nd}$ ed., Cold Spring Harbor Press, Plainsview, N.Y. (1989), and Ausubel et al., *Current Protocols in Molecular Biology* (Supplement 47), John Wiley & Sons, New York (1999), for definitions and terms of the art.

As used herein, the term "microRNA species," or ("microRNA") or ("miRNA") or "mi-R" refers to small, non-protein coding RNA molecules that are expressed in a diverse array of eukaryotes, including mammals. MicroRNA molecules typically have a length in the range of from 15 nucleotides to 120 nucleotides, the size depending upon the specific microRNA species and the degree of intracellular processing. Mature, fully processed miRNAs are about 15 to 30, 15-25, or 20 to 30 nucleotides in length, and more often between about 16 to 24, 17 to 23, 18 to 22, 19 to 21 or 21 to 24 nucleotides in length. MicroRNAs include processed sequences as well as corresponding long primary transcripts (pri-miRNAs) and processed precursors (pre-miRNAs). Some microRNA molecules function in living cells to regulate gene expression via RNA interference. A representative set of microRNA species is described in the publicly available miRBase sequence database as described in Griffith-Jones et al., *Nucleic Acids Research* 32:D109-D111 (2004) and Griffith-Jones et al., *Nucleic Acids Research* 34:D140-D144 (2006), accessible on the World Wide Web at the Wellcome Trust Sanger Institute website.

As used herein, the term "microRNA family" refers to a group of microRNA species that share identity across at least 6 consecutive nucleotides within nucleotide positions 1 to 12 of the 5' end of the microRNA molecule, also referred to as the "seed region," as described in Brennecke, J. et al., *PloS biol* 3(3):pe85 (2005).

As used herein, the term "microRNA family member" refers to a microRNA species that is a member of a microRNA family, including naturally occurring microRNA species and articifically generated microRNA molecules.

As used herein, the term "RNA interference" or "RNAi" refers to the silencing or decreasing of gene expression by iRNA agents (e.g., siRNAs, miRNAs, shRNAs), via the process of sequence-specific, post-transcriptional gene silencing in animals and plants, initiated by an iRNA agent that has a seed region sequence in the iRNA guide strand that is complementary to a sequence of the silenced gene.

As used herein, the term an "iRNA agent" (abbreviation for "interfering RNA agent"), refers to an RNA agent, or chemically modified RNA, which can down-regulate the expression of a target gene. While not wishing to be bound by theory, an iRNA agent may act by one or more of a number of mechanisms, including post-transcriptional cleavage of a target mRNA, or pre-transcriptional or pre-translational mechanisms. An iRNA agent can include a single strand (ss) or can include more than one strands, e.g. it can be a double stranded (ds) IRNA agent.

As used herein, the term "single strand iRNA agent" is an iRNA agent which consists of a single molecule. It may include a duplexed region, formed by intra-strand pairing, e.g., it may be, or include, a hairpin or panhandle structure. The ssRNA agents of the present invention include transcripts that adopt stem-loop structures, such as shRNA, that are processed into siRNA.

As used herein, the term "ds iRNA agent" is a dsRNA (double stranded RNA) agent that includes two strands that are not covalently linked, in which interchain hybridization can form a region of duplex structure. The dsRNA agents of the present invention include silencing dsRNA molecules that are sufficiently short that they do not trigger the interferon response in mammalian cells.

As used herein, the term "siRNA" refers to a small interfering RNA. siRNAs include short interfering RNA of about 15-60, 15-50, or 15-40 (duplex) nucleotides in length, more typically about 15-30, 15-25 or 19-25 (duplex) nucleotides in length, and is preferably about 20-24 or about 21-22 or 21-23 (duplex) nucleotides in length (e.g., each complementary sequence of the double stranded siRNA is 15-60, 15-50, 15-40, 15-30, 15-25 or 19-25 nucleotides in length, preferably about 20-24 or about 21-22, or 21-23 nucleotides in length, preferably 19-21 nucleotides in length, and the double stranded siRNA is about 15-60, 15-50, 15-40, 15-30, 15-25 or 19-25, preferably about 20-24, or about 21-22 or 19-21 or 21-23 base pairs in length). siRNA duplexes may comprise 3' overhanges of about 1 to about 4 nucleotides, preferably about 2 to 3 nucleotides and 5' phosphate termini. In some embodiments, the siRNA lacks a terminal phosphate. In some embodiments, one or both ends of siRNAs can include single-stranded 3' overhangs that are two or three nucleotides in length, such as, for example, deoxythymidine (dTdT) or uracil (UU) that are not complementary to the target sequence. In some embodiments, siRNA molecules can include nucleotide analogs (e.g., thiophosphate or G-clamp nucleotide analogs), alternative base linkages (e.g., phosphorothioate, phosphonoacetate, or thiophosphonoacetate) and other modifications useful for enhanced nuclease resistance, enhanced duplex stability, enhanced cellular uptake, or cell targeting.

In certain embodiments, at least one of the two strands of the siRNA further comprises a 1-4, preferably a 2 nucleotide 3' overhang. The nucleotide overhang can include any combination of a thymine, uracil, adenine, guanine, or cytosine, or derivatives or analogues thereof. The nucleotide overhang in certain aspects is a 2 nucleotide overhang, where both nucleotides are thymine. Importantly, when the dsRNA comprising the sense and antisense strands is administered, it directs target specific interference and bypasses an interferon response pathway. In order to enhance the stability of the short interfering nucleic acids, the 3' overhangs can also be stabilized against degradation. In one embodiment, the 3' overhangs are stabilized by including purine nucleotides, such as adenosine or guanosine nucleotides. Alternatively, substitution of pyrimidine nucleotides by modified analogues, e.g., substitution of uridine nucleotides in the 3' overhangs with 2'-deoxythymidine, is tolerated and does not affect the efficiency of RNAi degradation. In particular, the absence of a 2' hydroxyl in the 2'-deoxythymidine significantly enhances the nuclease resistance of the 3' overhang in tissue culture medium.

As used herein, a "3' overhang" refers to at least one unpaired nucleotide extending from the 3' end of an siRNA sequence. The 3' overhang can include ribonucleotides or deoxyribonucleotides or modified ribonucleotides or modified deoxyribonucleotides. The 3' overhang is preferably from 1 to about 5 nucleotides in length, more preferably from 1 to about 4 nucleotides in length and most preferably from about 2 to about 4 nucleotides in length. The 3' overhang can occur on the sense or antisense sequence, or on both sequences of an RNAi construct. The length of the overhangs can be the same or different for each strand of the duplex. Most preferably, a 3' overhang is present on both strands of the duplex, and the overhang for each strand is 2 nucleotides in length. For example, each strand of the duplex can comprise 3' overhangs of dithymidylic acid ("tt") or diuridylic acid ("uu").

As used herein, the siRNA molecules need not be limited to those molecules containing only RNA, but may further encompass chemically-modified nucleotides and non-nucleotides. WO2005/078097; WO2005/0020521 and WO2003/070918 detail various chemical modifications to RNAi molecules, and the contents of each reference is hereby incorporated by reference in its entirety. In certain embodiments, for example, the siRNA molecules may lack 2'-hydroxyl (2'-OH) containing nucleotides. The siRNA can be chemically synthesized or may be encoded by a plasmid (e.g., transcribed as sequences that automatically fold into duplexes with hairpin loops). siRNA can also be generated by cleavage of longer dsRNA (e.g., dsRNA greater than about 25 nucleotides in length) with the E. Coli RNAse III or Dicer. These enzymes process the dsRNA into biologically active siRNA (see, e.g., Yang et al., 2002 PNAS USA 99:9942-7; Calegari et al., 2002, PNAS USA 99:14236; Byrom et al., 2003, Ambion TechNotes 10(1): 4-6; Kawasaki et al., 2003, Nucleic Acids Res. 31: 981-7; Knight and Bass, 2001, Science 293: 2269-71; and Robertson et al., 1968, J. Biol. Chem. 243: 82). The long dsRNA can encode for an entire gene transcript or a partial gene transcript.

Non limiting examples of siRNA molecules of the invention may include a double-stranded polynucleotide molecule comprising self-complementary sense and antisense regions, wherein the antisense region comprises nucleotide sequence that is complementary to nucleotide sequence in a target nucleic acid molecule or a portion thereof (alternatively referred to as the guide region, or guide strand when the molecule contains two separate strands) and the sense region having nucleotide sequence corresponding to the target nucleic acid sequence or a portion thereof (also referred as the passenger region, or the passenger strand when the molecule contains two separate strands). The siRNA can be assembled from two separate oligonucleotides, where one strand is the sense strand and the other is the antisense strand, wherein the antisense and sense strands are self-complementary (i.e., each strand comprises nucleotide sequence that is complementary to nucleotide sequence in the other strand; such as where the antisense strand and sense strand form a duplex or double stranded structure, for example wherein the double stranded region is about 18 to about 30, e.g., about 18, 19, 20, 21, 22, 23, 24, 25, 26, 27, 28, 29 or 30 base pairs); the antisense strand (guide strand) comprises nucleotide sequence that is complementary to nucleotide sequence in a target nucleic acid molecule or a portion thereof and the sense strand (passenger strand) comprises nucleotide sequence corresponding to the target nucleic acid sequence or a portion thereof (e.g., about 15 to about 25 nucleotides of the siRNA molecule are complementary to the target nucleic acid or a portion thereof). Typically, a short interfering RNA (siRNA) refers to a double-stranded RNA molecule of about 17 to about 29 base pairs in length, preferably from 19-21 base pairs, one strand of which is complementary to a target mRNA, that when added to a cell having the target mRNA or produced in the cell in vivo, causes degradation of the target mRNA. Preferably the siRNA is perfectly complementary to the target mRNA. But it may have one or two mismatched base pairs.

Alternatively, the siRNA is assembled from a single oligonucleotide, where the self-complementary sense and antisense regions of the siRNA are linked by means of a nucleic acid based or non-nucleic acid-based linker(s). The siRNA can be a polynucleotide with a duplex, asymmetric duplex, hairpin or asymmetric hairpin secondary structure, having self-complementary sense and antisense regions, wherein the antisense region comprises nucleotide sequence that is complementary to nucleotide sequence in a separate target nucleic acid molecule or a portion thereof and the sense region having nucleotide sequence corresponding to the target nucleic acid sequence or a portion thereof. The siRNA can be a circular single-stranded polynucleotide having two or more loop structures and a stem comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof, and wherein the circular polynucleotide can be processed either in vivo or in vitro to generate an active siRNA molecule capable of mediating RNAi. The siRNA can also comprise a single stranded polynucleotide having nucleotide sequence complementary to nucleotide sequence in a target nucleic acid molecule or a portion thereof (for example, where such siRNA molecule does not require the presence within the siRNA molecule of nucleotide sequence corresponding to the target nucleic acid sequence or a portion thereof), wherein the single stranded polynucleotide can further comprise a terminal phosphate group, such as a 5'-phosphate (see for example Martinez et al., 2002, Cell 110:563-574 and Schwarz et al., 2002, Molecular Cell, 10:537-568), or 5',3'-diphosphate. In certain embodiments, the siRNA molecule of the invention comprises separate sense and antisense sequences or regions, wherein the sense and antisense regions are covalently linked by nucleotide or non-nucleotide linkers molecules as is known in the art, or are alternately non-covalently linked by ionic interactions, hydrogen bonding, van der waals interactions, hydrophobic interactions, and/or stacking interactions. In certain embodiments, the siRNA molecules of the invention comprise nucleotide sequence that is complementary to nucleotide sequence of a target gene. In another embodiment, the siRNA molecule of the invention interacts with nucleotide sequence of a target gene in a manner that causes inhibition of expression of the target gene.

As used herein, "percent modification" refers to the number of nucleotides in the iRNA, or each of the strand of the siRNA or to the collective dsRNA that have been modified. Thus 19% modification of the antisense strand refers to the modification of up to 4 nucleotides/bp in a 21 nucleotide sequence (21 mer). 100% refers to a fully modified dsRNA. The extent of chemical modification will depend upon various factors well known to one skilled in the art. Such, as for example, target mRNA, off-target silencing, degree of endonuclease degradation, etc.

As used herein, the term "shRNA" or "short hairpin RNAs" refers to individual transcripts that adopt stem-loop structures which are processed into siRNA by RNAi machinery. Typical shRNA molecules comprise two inverted repeats containing the sense and antisense target sequence separated by a loop sequence. The base-paired segment may vary from 17 to 29 nucleotides, wherein one strand of the base-paied stem is complementary to the mRNA of a target gene. The loop of the shRNA stem-loop structure may be any suitable length that allows inactivation of the target gene in vivo. While the loop may be from 3 to 30 nucleotides in length, typically it is 1-10 nucleotides in length. The base paired stem may be perfectly base paired or may have 1 or 2 mismatched base pairs. The duplex portion may, but typically does not, contain one or more bulges consisting of one or more unpaired nucleotides. The shRNA may have non-base-paired 5' and 3' sequences extending from the base-paired stem. Typically, however, there is no 5' extension. The first nucleotide of the shRNA at the 5' end is a G, because this is the first nucleotide transcribed by polymerase III. If G is not present as the first base in the target sequence, a G may be added before the specific target sequence. The 5' G typically forms a portion of the base-paired stem. Typically, the 3' end of the shRNA is a poly U segment that is a transcription termination signal and does not form a base-paired structure. As described in the application and known to one skilled in the art, shRNAs are processed into siRNAs by the conserved cellular RNAi machinery. Thus shRNAs are precursors of siRNAs and are, in general, similarly capable of inhibiting expression of a target mRNA transcript. For the purpose of description, in certain embodiments, the shRNA constructs of the invention target one or more mRNAs that are targeted by a member of the miR-16 family including miR-16, miR-15a, miR-15b, miR103, miR-107, miR-195 and kshv-miR-K12-6-5p. The strand of the shRNA that is antisense to the target gene transcript is also known as the "guide strand".

As used herein, the term "microRNA responsive target site" refers to a nucleic acid sequence ranging in size from about 5 to about 25 nucleotides (such as 5, 6, 7, 8, 9, 10, 11, 12, 13, 14, 15, 16, 17, 18, 19, 20, 21, 22, 23, 24, or 25 nucleotides) that is complementary (i.e., a direct match), or essentially complementary to at least a portion of a microRNA molecule. In some embodiments, the microRNA responsive target site comprises at least 6 consecutive nucleotides, at least 7 consecutive nucleotides, at least 8 consecutive nucleotides, or at least 9 consecutive nucleotides that are complementary to the seed region of a microRNA molecule (i.e., within positions 1 to 12 of the 5' end of the microRNA molecule, referred to as the "seed region." See, e.g., Brennecke, J. et al., *PloS biol* 3(3):pe85 (2005)).

As used herein, the term "isolated" in the context of an isolated nucleic acid molecule, is one which is altered or removed from the natural state through human intervention. For example, an RNA naturally present in a living animal is not "isolated." A synthetic RNA or dsRNA or microRNA molecule partially or completely separated from the coexisting materials of its natural state, is "isolated." Thus, an miRNA molecule which is deliberately delivered to or expressed in a cell is considered an "isolated" nucleic acid molecule.

As used herein, the term "complementary" refers to nucleic acid sequences that are capable of base-pairing according to the standard Watson-Crick complementary rules. That is, the larger purines will base pair with the smaller pyrimidines to form combinations of guanine paired with cytosine (G:C) and adenine paired with either thymine (A:T) in the case of DNA, or adenine paired with uracil (A:U) in the case of RNA.

As used herein, the term "essentially complementary" refers to microRNA target nucleic acid sequences that are longer than 5 nucleotides that are complementary (an exact match) to at least 5 consecutive nucleotides of the 5' portion of a microRNA molecule from nucleotide positions 1 to 12, (also referred to as the "seed region"), and are at least 85% complementary (such as at least 88%, at least 90%, at least 95%, or at least 96% identical) across the remainder of the microRNA target nucleic acid sequence as compared to a naturally occurring microRNA species set forth in the miR-Base sequence database, which is publically accessible on the World Wide Web at the Wellcome Trust Sanger Institute at http://microna.sangerac.uklsequences/, and as described in the following references: Ambros et al., *RNA* 9:277-279 (2003); Griffith-Jones, *Nucleic Acids Res.* 32:D109-D111 (2004); Griffith-Jones, *Nucleic Acids Res.* 34:D140-D144 (2006); Lagos-Quintana et al., *Curr. Biol.* 12(9):735-9 (2002); Lim LP et al., *Science* 299(5612):1540 (2003).

As used herein, the term "equivalent" with reference to a microRNA target sequence, is a nucleic acid sequence that is identical to at least 5 consecutive nucleotides of the 5' portion of a particular microRNA target sequence from nucleotide positions 1 to 12 (also referred to as the "seed region"), and is at least 85% identical (such as at least 88%, at least 90%, at least 95%, or at least 96% identical) to the remainder of the microRNA target sequence. The comparison of sequences and determination of percent identity and similarity between two sequences can be accomplished using a mathematical algorithm of Karlin and Altschul (*Proc. Natl. Acad. Sci. USA* 87:2264-2268 (1990)), modified as in Karlin and Atlschul (*Proc. Natl. Acad. Sci. USA* 90:5873-5877 (1993)). Such an algorithm is incorporated into the NBLAST and XBLAST programs of Altshcul et al. (*J. Mol. Biol.* 215:403-410 (1990)).

As used herein, the term "gene" refers to a nucleic acid (e.g., DNA or RNA) sequence that comprises coding sequences necessary for the production of an RNA and/or a polypeptide, or its precursor as well as noncoding sequences (untranslated regions) surrounding the 5' and 3' ends of the coding sequences. The term "gene" encompasses both cDNA and genomic forms of a gene. A functional polypeptide can be encoded by a full length coding sequence or by any portion of the coding sequence as long as the desired activity or functional properties (e.g., enzymatic activity, ligand binding, signal transduction, antigenic presentation) of the polypeptide are retained. The sequences which are located 5' of the coding region and which are present on the mRNA are referred to as 5' untranslated sequences ("5'UTR"). The sequences which are located 3' or downstream of the coding region and which are present on the mRNA are referred to as 3' untranslated sequences, or ("3'UTR").

As used herein, the term "expression cassette" refers to a nucleic acid molecule which comprises at least one nucleic acid sequence that is to be expressed, along with its transcription and translational control sequences. The expression cassette typically includes restriction sites engineered to be present at the 5' and 3' ends such that the cassette can be easily inserted, removed, or replaced in a gene delivery vector. Changing the cassette will cause the gene delivery vector into which it is incorporated to direct the expression of a different sequence.

As used herein, the term "phenotype" encompasses the meaning known to one of skill in the art, including modulation of the expression of one or more genes, as measured by gene expression analysis or protein expression analysis.

As used herein, the term "source of biological knowledge" refers to information that describes the function (e.g., at molecular, cellular and system levels), structure, pathological roles, toxicological implications, etc., of a multiplicity of genes. Various sources of biological knowledge can be used for the methods of the invention, including databases and information collected from public sources such as Locuslink, Unigene, SwissTrEMBL, etc., and organized into a relational database following the concept of the central dogma of molecular biology. In some embodiments, the annotation systems used by the Gene Ontology (GO) Consortium or similar systems are employed. GO is a dynamic controlled vocabulary for molecular biology which can be applied to all organisms as knowledge of gene is accumulating and changing, it is developed and maintained by Gene Ontology™ Consortium (*Gene Ontology*: tool for the unification of biology. The Gene Ontology Consortium (2000), *Nature Genet.* 25:25-29)).

As used herein, the phrase to "inhibit the proliferation of a mammalian cell" means to kill the cell, or permanently or temporarily arrest the growth of the cell. Inhibition of a mammalian cell can be inferred if the number of such cells, either in an in vitro culture vessel, or in a subject, remains constant or decreases after administration of the compositions of the invention. An inhibition of tumor cell proliferation can also be inferred if the absolute number of such cells increases, but the rate of tumor growth decreases.

The phrase "inhibiting expression of a target gene" refers to the ability of an RNAi agent, such as an siRNA, to silence, reduce, or inhibit expression of a target gene. Said another way, to "inhibit", "down-regulate", or "reduce", it is meant that the expression of the gene, or level of RNA molecules or equivalent RNA molecules encoding one or more proteins or protein subunits, or activity of one or more proteins or protein subunits, is reduced below that observed in the absence of the RNAi agent. For example, an embodiment of the invention proposes inhibiting, down-regulating or reducing expression of one or more miR-16 responsive genes, by introduction of an miR-16-like siRNA molecule, below the level observed for that miR-16 responsive gene in a control cell to which an miR-16-like siRNA molecule has not been introduced. In another embodiment, inhibition, down-regulation, or reduction contemplates inhibition of the target mRNA below the level observed in the presence of, for example, an siRNA molecule with scrambled sequence or with mismatches. In yet another embodiment, inhibition, down-regulation, or reduction of gene expression with a siRNA molecule of the instant invention is greater in the presence of the invention siRNA e.g., siRNA that down regulates one or more miR-16 responsive gene mRNAs levels than in its absence. In one embodiment, inhibition, down regulation, or reduction of gene expression is associated with post transcriptional silencing, such as RNAi mediated cleavage of a target nucleic acid molecule (e.g. RNA) or inhibition of translation.

To examine the extent of gene silencing, a test sample (e.g., a biological sample from organism of interest expressing the target gene(s) or a sample of cells in culture expressing the target gene(s)) is contacted with an siRNA that silences, reduces, or inhibits expression of the target gene(s). Expression of the target gene in the test sample is compared to expression of the target gene in a control sample (e.g., a biological sample from organism of interest expressing the target gene or a sample of cells in culture expressing the target gene) that is not contacted with the siRNA. Control samples (i.e., samples expressing the target gene) are assigned a value of 100%. Silencing, inhibition, or reduction of expression of a target gene is achieved when the value of test the test sample relative to the control sample is about 95%, 90%, 85%, 80%, 75%, 70%, 65%, 60%, 55%, 50%, 45%, 40%, 35%, 30%, 25%, 20%, or 10%. Suitable assays include, e.g., examination of protein or mRNA levels using techniques known to those of skill in the art such as dot blots, northern blots, in situ hybridization, ELISA, microarray hybridization, immunoprecipitation, enzyme function, as well as phenotypic assays known to those of skill in the art.

An "effective amount" or "therapeutically effective amount" of an siRNA or an RNAi agent is an amount sufficient to produce the desired effect, e.g., inhibition of expression of a target sequence in comparison to the normal expression level detected in the absence of the siRNA or RNAi agent. Inhibition of expression of a target gene or target sequence by a siRNA or RNAi agent is achieved when the expression level of the target gene mRNA or protein is about 90%, 80%, 70%, 60%, 50%, 40%, 30%, 25%, 20%, 15%, 10%, 5%, or 0% relative to the expression level of the target gene mRNA or protein of a control sample.

In one aspect, the present invention provides a method for identifying a subset of genes that are responsive to a selected microRNA species and share at least one phenotype, the method comprising: a) modulating the level of at least one microRNA species in a cell type of interest; b) measuring the level of expression of each member of a plurality of genes in the modulated cells to yield a plurality of expression values; c) measuring the level of expression of each member of the same plurality of genes in a reference cell type that is not modulated to yield a plurality of reference expression values; d) comparing the plurality of expression values from the modulated cells with the plurality of reference expression values to identify a set of genes that are responsive to the microRNA species, each identified gene having an expression value that is statistically different from the corresponding reference value; e) identifying transcripts within the set of genes that contain at least one microRNA responsive target sequence corresponding to the modulated microRNA species; f) modulating the level of expression of a plurality of members of the set of genes that are responsive to the microRNA species and that contain at least one microRNA responsive target sequence in the cell type of interest with a plurality of gene-specific agents; and g) comparing the cells modulated in step (a) and the cells modulated in step (f) for the presence of at least one shared phenotype to identify a subset of genes that are responsive to the selected microRNA species and exhibit a shared phenotype.

FIG. 1 illustrates an exemplary method of identifying a subset of genes that are responsive to a selected microRNA species and share at least one phenotype, in accordance with an embodiment of the present invention. The methods of this aspect of the invention may be used to identify one or more functions of a selected microRNA species and/or to identify a subset of genes that are responsive to any microRNA in any cell type.

Figure 3:
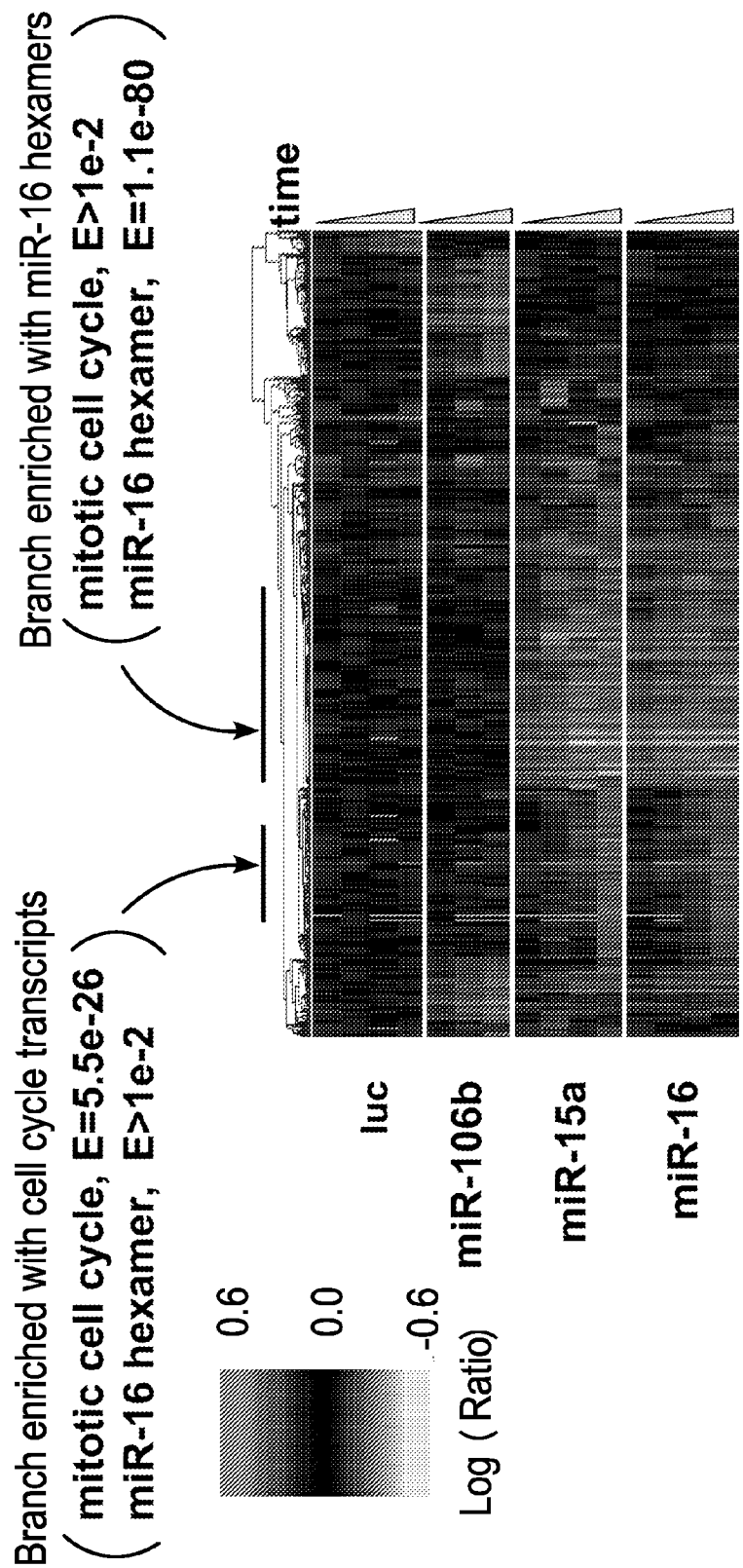
FIG. 3 is a representative heat map illustrating cell cycle gene regulation of selected genes after transfection with miR-15a and miR-16 duplexes, as described in EXAMPLE 2.
Figure 4:
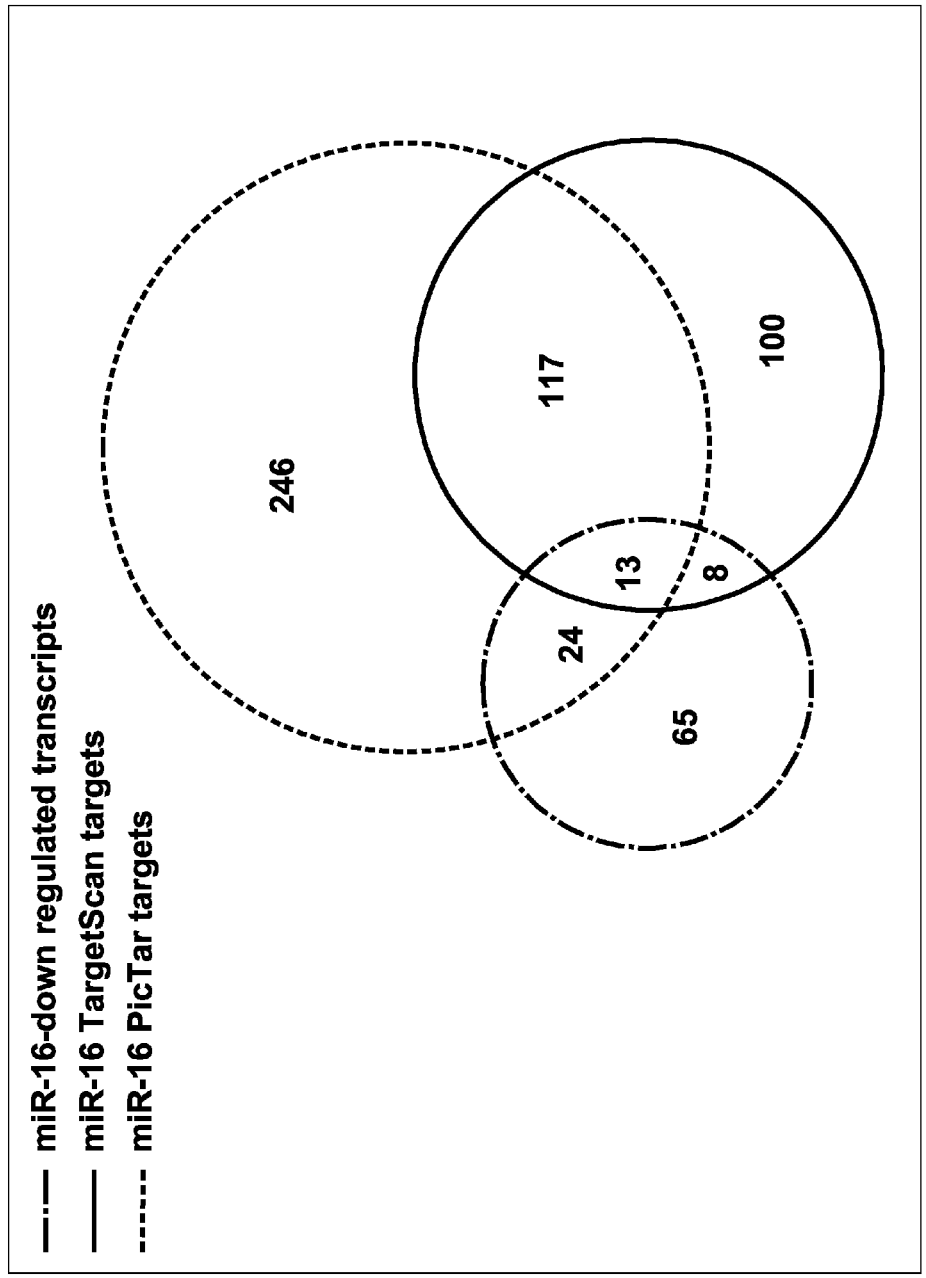
FIG. 4 is a diagram illustrating the overlap between miR-16 consensus downregulated transcripts identified in accordance with an embodiment of the method of invention and miR-16 targets predicted by various computational methods, as described in EXAMPLE 2.

As shown in FIG. 4, and described in more detail in EXAMPLE 2, a unique set of microRNA responsive genes were identified using various embodiments of the methods of the present invention that were not previously predicted by computational methods. Moreover, using the methods described herein, a subset of genes responsive to the miR-16 family have been discovered that share a cell cycle phenotype, as described in more detail in EXAMPLES 1-7 and FIGS. 1-8. It has further been demonstrated that the subset of identified genes function in a coordinated fashion. A combination of gene-specific agents directed against at least two or more of the miR-16 responsive subset of genes identified as being associated with cell cycle regulation resulted in a superadditive (i.e., synergistic) cell cycle phenotype. Therefore, the methods of this aspect of the invention are useful to identify a subset of microRNA responsive genes that are likely to be relevant therapeutic targets, especially when targeted in a combination therapy.

In accordance with the methods of this aspect of the invention, the level of at least one microRNA species is modulated (i.e., increased or decreased) in a cell type of interest. In one embodiment, the level of microRNA species is decreased in a cell type of interest. A decrease in microRNA expression may be achieved using any suitable method, such as introducing an inhibitory agent, such as an iRNA agent selected to inhibit expression of the endogenous gene encoding the microRNA.

In another embodiment, the level of microRNA species is increased in a cell type of interest. An increase in expression of a microRNA species may be achieved using any suitable method, such as by inducing expression of the endogenous microRNA species, by introducing an expression vector encoding a microRNA, or by introducing one or more microRNA duplex molecules into the cell type of interest.

The methods of this aspect of the invention can be practiced to modulate the level of any microRNA gene product in a cell type of interest. Cellular endogenous microRNAs (miRNAs) are an evolutionary conserved group of noncoding 17-24 nucleotide long single-stranded RNA molecules that are expressed in plants and animals (see, Bartel, D. P., *Cell* 116: 281-297, 2004). MicroRNA single-strands are often referred to in the art as "guide strands" or "active strands", while the complement to the active strand is referred to as the "passenger strand." MicroRNAs have been shown to inhibit the expression of target genes by interacting with complementary sites in the 3' untranslated region (UTR) of the target mRNAs (see, Olsen et al., *Dev. Biol.* 216:671-680 (1999); Bartel et al., *Cell* 116:281-297 (2004)). Although most predicted microRNA target recognition sites lie in 3' UTR regions, other regions, including coding region recognition is also observed (Brennecke, J. et al., *PloS Biol.* 3(3):pe85 (2005); Lewis, B. P. et al., *Cell* 120(1):15-20 (2005)). Genetic and biochemical studies have indicated that microRNAs are processed to their mature forms by RNAse III family nucleases, and function through RNA-mediated interference (RNAi) and related pathways to regulate the expression of target genes (Hannon et al., *Nature* 418:244-251 (2002); Pasquinelli et al., *Annu. Rev. Cell Dev. Biol.* 18:495-513 (2002)). These microRNAs function as natural triggers of the RNAi pathway.

Computational and molecular cloning approaches have revealed hundreds of microRNAs that are expressed at various levels in a variety of organisms. Over 200 different mammalian microRNAs have been identified, as described in the "miRBase sequence database" which is publically accessible on the World Wide Web at the Wellcome Trust Sanger Institute website at http://microrna.sanger.ac.uk/sequences/. A list of exemplary microRNA species is also described in the following references: Ambros et al., *RNA* 9:277-279 (2003); Griffith-Jones, *Nucleic Acids Res.* 32:D109-D111 (2004); Griffith-Jones, *Nucleic Acids Res.* 34:D140-D144 (2006); Lagos-Quintana et al., *Curr. Biol.* 12(9):735-9 (2002); Lim, L. P., et al., *Science* 299(5612):1540 (2003).

MicroRNA expression studies have revealed tissue-specific expression levels of microRNA species in mouse embryos (Mansfield et al., *Nature Genetics* 36(10):1079-1083 (2004); Houbaviy et al., *Developmental Cell* 5:351-358 (2003)); human (Sempere et al., *Genome Biology* 5:R13 (2004); Thompson et al., *Nature Methods* 1(1):1-7 (2004); Sun, Y. et al., *Nucl. Acid Res.* 32(22):e188 (2004); Liu et al., *Proc. Natl Acad. Sci.* 101(5):9740-9744 (2004); Lu et al., *Nature* 435:834-838 (2005); Barad et al., *Genome Research* 14:2487-2494 (2004); Baskerville et al., *RNA* 11:241-247 (2005)); and zebrafish (Wienholds et al., *Science* 309:310-311 (2005)). The high conservation of expression of tissue specific and tissue-enriched miRNAs between species suggests that miRNAs may play a conserved role in the establishment and/or maintenance of a cell or tissue type (see, Sempere et al., *Genome Biology* 5:R13 (2004)).

Families of microRNAs have been identified whose members share a region of 5' identity but differ in their 3' ends. It has been shown that two different microRNA family members that shared a common 5' sequence that was complementary to a single 8-mer seed site in the bagpipe 3' UTR were capable of repressing expression of a reporter gene containing the 8-mer target, even though the 3' ends of the microRNAs differed, indicating that the target site was responsive to both microRNAs in this family (Brennecke et al., *PloS Biology* 3(3):e85 (2005)). For example, FIG. 2 provides an alignment of microRNA responsive target sequences for several microRNA families, with conserved seed regions. As shown in FIG. 2, the miR-16 family includes hsa-miR-15a, hsa-miR-15b, hsa-miR-16, hsa-miR103, hsa-miR-107, hsa-miR-195 and kshv-miR-K12-6-5p. As demonstrated in more detail in EXAMPLES 1-7, it has been found that members of the miR-16 family regulate the G0/G1 cell cycle transition.

In one embodiment, the level of at least one microRNA species is increased in a cell type of interest by introducing the microRNA species into the cell. The introduced microRNA species may be encoded in an expression vector, or may be a chemically synthesized or recombinantly produced gene product. The microRNA species for use in the practice of the methods of the invention can be obtained using a number of standard techniques. For example, the gene products can be chemically synthesized or recombinantly produced as described in more detail below.

The microRNA species may be introduced into the cell using various methods such as infection with a viral vector encoding the microRNA, microinjection, or by transfection using electroporation or with the use of a transfection agent. Transfection methods for mammalian cells are well known in the art, and include direct injection of the nucleic acid into the nucleus of a cell, electroporation, liposome transfer or transfer mediated by lipophilic materials, receptor mediated nucleic acid delivery, bioballistic or particle acceleration, calcium phosphosphate precipitation and transfection mediated by viral vectors. For example, cells can be transfected with a liposomal transfer compound, e.g., DOTAP (N-[1-(2, 3-dioleoyloxy)propyl]-N,N,N,-trimethyl-ammonium methylsulfate, Boehringer-Mannheim) or an equivalent, such as LIPOFECTIN. An exemplary method for transfecting miRNA into mammalian cells is described in EXAMPLE 1.

The methods of this aspect of the invention may be practiced using any cell type, such as primary cells or an established line of cultured cells may be used in the practice of the methods of the invention. For example, the methods may be used in any mammalian cell from a variety of species, such as a cow, horse, mouse, rat, dog, pig, goat, or primate, including a human. In some embodiments, the methods may be used in a mammalian cell type that has been modified, such as a cell type derived from a transgenic animal or a knockout mouse. In another embodiment, the microRNA is modulated in a cell type of interest due to infection with a virus that naturally encodes a microRNA, such as kshv-miR-K12-6-5p, which encodes a member of the miR-16 family (see Cai et al., *PNAS* 102:5570-5575 (2005)).

In some embodiments, the method of the invention is practiced using a cancer cell type. Representative examples of suitable cancer cell types that can be cultured in vitro and used in the practice of the present invention are colon cancer cells, such as wild type HCT116, wild-type DLD-1, HCT116Dicer$^{ex5}$ and DLD-1 Dicer$^{ex5}$ cells described in Cummins, J. M., et al., *PNAS* 103(10):3687-3692 (2006)). Other non-limiting examples of suitable cancer cell types include A549, MCF7, and TOV21G and are available from the American Type Culture Collection, Rockville, Md. In further embodiments, the cell type is an microRNA mediated cancer cell type. For example, it has been shown that miR-17, 18, 19, 20, 25, 92, 93 and 106 corresponds to clusters of miRNAs that have been found to be expressed in skeletal muscle and dendritic cells and upregulated by Myc (O'Donnell et al., *Nature* 435:828 (2005)) and to promote tumor growth in a mouse model of B-cell lymphoma (He et al., *Nature* 435:828 (2005)). As another example, it has been shown that the locus encoding miR-15a and miR-16 at 13q14 is deleted in more than half of B cell chronic lymphocytic leukemias (CLL) (Calin et al., *PNAS* 99:15524-15529 (2002)). miR-16 is also subject to mutations in CLL patients, but not control subjects, and its locus is subject to loss of heterozygosity (Calin et al., *N Engl J Med* 353:1793-1801 (2005)). Taken together, these findings suggest that the miR-15a/miR-16 locus behaves as a classical tumor suppressor locus. As described herein, it has been observed that the miR-16 family of microRNAs negatively regulates cell cycle progression by inducing G0/G1 cell cycle accumulation via coordinate regulation of miR-16 responsive targets. Accordingly, in some embodiments, the methods can be used to identify microRNA responsive genes in miR-15 or miR-16 mediated cancer cells, such as, for example, CLL or prostate cancer cells that may be useful as therapeutic targets, either alone, or in combination.

Identification of MicroRNA-responsive Modulated Transcripts

In the practice of this aspect of the invention, the amount of gene expression (as determined by measuring the amount of mRNA transcribed from a gene, or as represented by the amount of cDNA made from the transcribed mRNA, or as measured by the amount of protein produced that is encoded by the gene) is measured and compared to reference values to yield gene expression patterns that provide information about the effect of a microRNA (or IRNA agent) on a selected cell type. Any method of gene expression analysis may be utilized, such as RNA profiling using Northern blots, quantitative PCR, microarray hybridization analysis, or protein profiling using protein detection methods such as antibody detection methods, (e.g., immunoblots, ELISAs) or mass spectrometry, and the like.

In one embodiment of the method, a set of microRNA-responsive modulated transcripts are identified by measuring the gene expression profile in the microRNA transfected cells in comparison to the gene expression profile in a reference sample, such as mock-transfected cells, to yield an expression value for each transcript within the population of measured transcripts, and then performing at least one calculation on all of the expression values to yield an expression value that numerically represents the expression pattern of the population of genes in response to the microRNA. In some embodiments of the invention, two separate cell lines are transfected in parallel with the same microRNA(s), as described in EXAMPLE 1 and an intersection value is then obtained to provide a more accurate representation of gene expression.

In one embodiment, RNA transcript levels are measured to assess gene expression. Any suitable RNA preparation can be utilized, such as total cellular RNA, or such as cytoplasmic RNA or such as an RNA preparation that is enriched for messenger RNA (mRNA), such as RNA preparations that include greater than 70%, or greater than 80%, or greater than 90%, or greater than 95%, or greater than 99% messenger RNA. Typically, RNA preparations that are enriched for messenger RNA are utilized to provide the RNA template in the practice of the methods of this aspect of the invention. Messenger RNA can be purified in accordance with any art-recognized method, such as by the use of oligo-dT columns (see, e.g., Sambrook et al. 1989, *Molecular Cloning—A Laboratory Manual* (2nd Ed.), Vol. 1, Chapter 7, Cold Spring Harbor Laboratory, Cold Spring Harbor, N.Y.). In a specific embodiment, the mRNA molecules in the RNA sample comprise at least 100 different nucleotide sequences. In other embodiments, the mRNA molecules of the RNA sample comprise at least 500, 1,000, 5,000, 10,000, 20,000, 30,000, 40,000, 50,000, 60,000, 70,000, 80,000, 90,000 or 100,000 different nucleotide sequences. In another specific embodiment, the RNA sample is a mammalian RNA sample, the mRNA molecules of the mammalian RNA sample comprising about 20,000 to 30,000 different nucleotide sequences, or comprising substantially all of the different mRNA sequences that are expressed in the cell(s) from which the mRNA was extracted. In some embodiments, the RNA is isolated from the microRNA transfected cells during a time period from about 4 hours to about 24 hours. In some embodiments, the RNA is isolated within 6 hours after transfection.

In one exemplary embodiment of the method, the gene expression profile of the microRNA modulated cells is measured by microarray hybridization. In accordance with this embodiment, after transfection of microRNA molecules into a desired cell type messenger RNA is extracted (and may or may not be purified) from the transfected cells and may be used as a template to synthesize cDNA or cRNA which is then labeled (e.g., with a fluorescent dye). In some embodiments of the method the labeled cDNA or cRNA is then hybridized to nucleic acid molecules immobilized on a substrate (e.g., a DNA microarray). The immobilized nucleic acid molecules represent some, or all, of the genes that are expressed in the cells that were transfected with the at least one microRNA. The labeled cDNA or cRNA molecules that hybridize to the nucleic acid molecules immobilized on the DNA array are identified, and the level of expression of each hybridizing cDNA or cRNA is measured and compared to the level of expression of the same cDNA or cRNA species in control cells that were not transfected, thereby revealing a gene expression pattern that was caused by the microRNA.

In some embodiments of the method, cDNA molecules are synthesized that are complementary to the RNA template molecules. Each cDNA molecule is preferably sufficiently long (e.g., at least 50 nucleotides in length) to subsequently serve as a specific probe for the mRNA template from which it was synthesized, or to serve as a specific probe for a DNA sequence that is identical to the sequence of the mRNA template from which the cDNA molecule was synthesized. Individual DNA molecules can be complementary to a whole RNA template molecule, or to a portion thereof. Thus, a population of cDNA molecules is synthesized that includes individual DNA molecules that are each complementary to all, or to a portion, of a template RNA molecule. Typically, at least a portion of the complementary sequence of at least 95% (more typically at least 99%) of the template RNA molecules are represented in the population of cDNA molecules.

Any reverse transcriptase molecule can be utilized to synthesize the cDNA molecules, such as reverse transcriptase molecules derived from Moloney murine leukemia virus (MMLV-RT), avian myeloblastosis virus (AMV-RT), bovine leukemia virus (BLV-RT), Rous sarcoma virus (RSV) and human immunodeficiency virus (HIV-RT). A reverse transcriptase lacking RNaseH activity (e.g., SUPERSCRIPT II™ sold by Stratagene, La Jolla, Calif.) has the advantage that, in the absence of an RNaseH activity, synthesis of second strand cDNA molecules does not occur during synthesis of first strand cDNA molecules. The reverse transcriptase molecule should also preferably be thermostable so that the cDNA synthesis reaction can be conducted at as high a temperature as possible, while still permitting hybridization of any required primer(s) to the RNA template molecules.

The synthesis of the cDNA molecules can be primed using any suitable primer, typically an oligonucleotide in the range of ten to 60 bases in length. Oligonucleotides that are useful for priming the synthesis of the cDNA molecules can hybridize to any portion of the RNA template molecules, including the oligo-dT tail. In some embodiments, the synthesis of the cDNA molecules is primed using a mixture of primers, such as a mixture of primers having random nucleotide sequences. Typically, for oligonucleotide molecules less than 100 bases in length, hybridization conditions are 5° C. to 10° C. below the homoduplex melting temperature (Tm); (see generally, Sambrook et al. *Molecular Cloning: A Laboratoy Manual*, 2nd ed., Cold Spring Harbor Press, 1987; Ausubel et al., *Current Protocols in Molecular Biology*, Greene Publishing, 1987).

The cDNA molecules are typically labeled to facilitate the detection of the cDNA molecules when they are used as a probe in a hybridization experiment, such as a probe used to screen a DNA microarray, to identify an efficacy-related population of genes. The cDNA molecules can be labeled with any useful label, such as a radioactive atom (e.g., $^{32}$P), but typically the cDNA molecules are labeled with a dye. Examples of suitable dyes include fluorophores and chemiluminescers.

In the context of the present example, the labeled cDNA is hybridized to a DNA array that includes hundreds, or thousands, of identified nucleic acid molecules (e.g., cDNA molecules) that correspond to genes that are expressed in the type of cells wherein gene expression is being analyzed. Typically, hybridization conditions used to hybridize the labeled cDNA to a DNA array are no more than 25° C. to 30° C. (for example, 10° C.) below the melting temperature (Tm) of the native duplex of the cDNA that has the lowest melting temperature (see generally, Sambrook et al., *Molecular Cloning: A Laboratory Manual*, 2nd ed., Cold Spring Harbor Press, 1987; Ausubel et al., *Current Protocols in Molecular Biology*, Greene Publishing, 1987). Tm for nucleic acid molecules greater than about 100 bases can be calculated by the formula Tm=81.5+0.41% (G+C)−log(Na+). For oligonucleotide molecules less than 100 bases in length, exemplary hybridization conditions are 5° to 10° C. below Tm.

In one embodiment, the microarray is an array of polynucleotide probes, the array comprising a support with at least one surface and typically at least 100 different polynucleotide probes, each different polynucleotide probe comprising a different nucleotide sequence and being attached to the surface of the support in a different location on the surface. For example, the nucleotide sequence of each of the different polynucleotide probes can be in the range of 40 to 80 nucleotides in length. For example, the nucleotide sequence of each of the different polynucleotide probes can be in the range of 50 to 70 nucleotides in length. For example, the nucleotide sequence of each of the different polynucleotide probes can be in the range of 50 to 60 nucleotides in length. In specific embodiments, the array comprises polynucleotide probes of at least 2,000, 4,000, 10,000, 15,000, 20,000, 50,000, 80,000, or 100,000 different nucleotide sequences.

Thus, the array can include polynucleotide probes for most, or all, genes expressed in a cell, tissue, organ or organism. In a specific embodiment, the cell or organism is a mammalian cell or organism. In another specific embodiment, the cell or organism is a human cell or organism. In specific embodiments, the nucleotide sequences of the different polynucleotide probes of the array are specific for at least 50%, at least 75%, at least 80%, at least 85%, at least 90%, at least 95%, or at least 99% of the genes in the genome of the cell or organism. Most preferably, the nucleotide sequences of the different polynucleotide probes of the array are specific for all of the genes in the genome of the cell or organism. In specific embodiments, the polynucleotide probes of the array hybridize specifically and distinguishably to at least 10,000, to at least 20,000, to at least 50,000, to at least 80,000, or to at least 100,000 different polynucleotide sequences. In other specific embodiments, the polynucleotide probes of the array hybridize specifically and distinguishably to at least 90%, at least 95%, or at least 99% of the genes or gene transcripts of the genome of a cell or organism. In some embodiments, the polynucleotide probes of the array hybridize specifically and distinguishably to the genes or gene transcripts of the entire genome of a cell or organism. In further embodiments, the microarray may be designed to contain a set of probes corresponding to a set of transcripts known to be modulated in a selected biological pathway.

The use of a two-color fluorescence labeling and detection scheme to define alterations in gene expression has been described, e.g., in Schena et al. 1995, *Science* 270:467-470, which is incorporated by reference in its entirety for all purposes. An advantage of using cDNA molecules labeled with two different fluorophores is that a direct and internally controlled comparison of the mRNA levels corresponding to each arrayed gene in two cell states can be made, and variations due to minor differences in experimental conditions (e.g., hybridization conditions) will not affect subsequent analyses. However, it will be recognized that it is also possible to use cDNA molecules from a single cell, and compare, for example, the absolute amount of a particular mRNA in, e.g., a drug-treated or an untreated cell.

Exemplary microarrays and methods for their manufacture and use are set forth in Hughes, T. R., et al., *Nature Biotechnology* 19:342-347 (April 2001), which publication is incorporated herein by reference.

Signal detection and data analysis. When fluorescently labeled probes are used, the fluorescence emissions at each site of an array can be detected by scanning confocal laser microscopy. In one embodiment, a separate scan, using the appropriate excitation line, is carried out for each of the two fluorophores used. Alternatively, a laser can be used that allows simultaneous specimen illumination at wavelengths specific to the two fluorophores and emissions from the two fluorophores can be analyzed simultaneously (see Shalon et al. 1996, *Genome Research* 6:639-645, which is incorporated by reference in its entirety for all purposes). In one embodiment, the arrays are scanned with a laser fluorescent scanner with a computer controlled X-Y stage and a microscope objective. Sequential excitation of the two fluorophores is achieved with a multi-line, mixed gas laser and the emitted light is split by wavelength and detected with two photomultiplier tubes. Fluorescence laser scanning devices are described in Shalon et al. *Genome Res.* 6:639-645 (1996), and in other references cited herein. Alternatively, the fiber-optic bundle described by Ferguson et al. *Nature Biotechnol.* 14:1681-1684 (1996), may be used to monitor mRNA abundance levels at a large number of sites simultaneously.

Signals are recorded and may be analyzed by computer, e.g., using a 12 bit analog to digital board. In some embodiments the scanned image is despeckled using a graphics program (e.g., Hijaak Graphics Suite) and then analyzed using an image gridding program that creates a spreadsheet of the average hybridization at each wavelength at each site. If necessary, an experimentally determined correction for "cross talk" (or overlap) between the channels for the two fluors may be made. For any particular hybridization site on the transcript array, a ratio of the emission of the two fluorophores can be calculated. The ratio is independent of the absolute expression level of the cognate gene, but is useful for genes whose expression is significantly modulated by drug administration.

The relative abundance of an mRNA in two biological samples is scored as a perturbation and its magnitude determined (i.e., the abundance is different in the two sources of mRNA tested), or as not perturbed (i.e., the relative abundance is the same). Preferably, in addition to identifying a perturbation as positive or negative, it is advantageous to determine the magnitude of the perturbation. This can be carried out, as noted above, by calculating the ratio of the emission of the two fluorophores used for differential labeling, or by analogous methods that will be readily apparent to those of skill in the art.

By way of example, two samples, each labeled with a different fluor, are hybridized simultaneously to permit differential expression measurements. If neither sample hybridizes to a given spot in the array, no fluorescence will be seen. If only one hybridizes to a given spot, the color of the resulting fluorescence will correspond to that of the fluor used to label the hybridizing sample (for example, green if the sample was labeled with Cy3, or red, if the sample was labeled with Cy5).

If both samples hybridize to the same spot, an intermediate color is produced (for example, yellow if the samples were labeled with fluorescein and rhodamine). Then, applying methods of pattern recognition and data analysis known in the art, it is possible to quantify differences in gene expression between the samples. Methods of pattern recognition and data analysis are described in e.g., International Publication WO 00/24936, which is incorporated by reference herein.

Comparison of Gene Expression Levels: In accordance with the methods of the invention, a set of genes are identified that are responsive to the microRNA species, wherein each individual gene has an expression value in response to the modulated level of microRNA that is significantly different from the corresponding reference expression value. An expression value is considered to display a statistically significant difference (either increased or decreased) in expression level ($p<0.05$) relative to a control, such as a mock-transfected cells.

Art-recognized statistical techniques can be used to compare the levels of expression of individual genes, or proteins, to identify genes, which exhibit significantly regulated expression levels in microRNA or siRNA transfected cells as compared to untreated cells. Thus, for example, a t-test can be used to determine whether the mean value of repeated measurements of the level of expression of a particular gene, is significantly regulated in a cell transfected with a particular microRNA or siRNA molecule compared to the same cell type that has not been transfected. Similarly, Analysis of Variance (ANOVA) can be used to compare the mean values of two or more populations (e.g., two or more populations of cultured cells treated with different amounts of a candidate drug) to determine whether the means are significantly different.

The following publications describe examples of art-recognized techniques that can be used to compare the levels of expression of individual genes, or proteins, in treated and untreated living things, or in diseased and non-diseased living things, to identify genes which exhibit significantly different expression levels: *Nature Genetics*, Vol. 32, pp. 461-552 (supplement December 2002); *Bioinformatics* 18(4):546-54 (April 2002); Dudoit et al. *Technical Report* 578, University of California at Berkeley; Tusher et al., *Proc. Nat'l. Acad. Sci. U.S.A.* 98(9):5116-5121 (April 2001); and Kerr et al., *J. Comput. Biol.* 7:819-837.

Representative examples of other statistical tests that are useful in the practice of the present invention include the chi squared test which can be used, for example, to test for association between two factors (e.g., transcriptional induction, or repression, by a drug molecule and positive or negative correlation with the presence of a disease state). Again by way of example, art-recognized correlation analysis techniques can be used to test whether a correlation exists between two sets of measurements (e.g., between gene expression and disease state). For example, an error model may be used to analyze microarray data as described by Weng L. et al., Bioinformatics 22(9): 111-21 (2006), incorporated herein by reference. Standard statistical techniques can be also be found in statistical texts, such as Modern Elementary Statistics, John E. Freund, 7$^{th}$ edition, published by Prentice-Hall; and Practical Statistics for Environmental and Biological Scientists, John Townend, published by John Wiley & Sons, Ltd.

Identification of at Least One microRNA Responsive Target Site in the Transcripts of the Set of microRNA Responsive Genes In accordance with the method of the invention, transcripts within the set of microRNA responsive genes identified in the microRNA modulated cells are analyzed for the presence of at least one microRNA responsive target site corresponding to the modulated microRNA species. A microRNA responsive target site refers to a nucleic acid sequence ranging in size from about 5 to about 25 nucleotides that corresponds to the modulated microRNA. The microRNA responsive target site may be complementary (i.e., a direct match) or essentially complementary to at least a portion of the modulated microRNA molecule, or a family member thereof. In some embodiments, the microRNA responsive target site comprises a sequence that is complementary (a direct match) to at least 6 consecutive nucleotides (referred to as a hexamer) of the 5' portion of the microRNA molecule from nucleotide positions 1 to 12 (referred to as the seed region). Exemplary seed regions for several microRNA families are provided in FIG. 2. The seed regions for additional exemplary mammalian microRNAs useful in the practice of the methods of the invention are described in the publically available "miRBase sequence database" as described in Griffith-Jones et al. (2004), *Nucleic Acid Research* 32:D109-D111 and Griffith-Jones et al. (2006), *Nucleic Acids Research* 34:D140-D144, accessible on the World Wide Web at the Wellcome Trust Sanger Institute website.

The regulated transcripts may be analyzed for the presence of a microRNA responsive target site by querying a database of stored sequence information, or may be directly analyzed by hybridization to a probe, PCR amplification or direct sequencing.

The microRNA responsive target site may be present in any region of the downregulated transcript, such as the 5' UTR, coding region, or 3' UTR. It has been shown that microRNAs inhibit the expression of target genes by interacting with complementary sites in the 3' untranslated region (UTR) of the target mRNAs (see Olsen et al., *Dev Biol* 216:671-680 (1999); Bartel et al., *Cell* 116:281-297 (2004)). However, other regions, including coding region recognition have also been observed (Brennecke et al., *PloS Biol* 3(3):pe85 (2005)). Accordingly, in some embodiments, the method includes the step of identifying at least one microRNA responsive target region in the 3' UTR of the regulated transcript. In some embodiments, the method includes the step of identifying at least two sequences corresponding to at least two seed regions in the 3' UTR of the regulated transcript. For example, as described in EXAMPLE 1 and TABLE 3, it has been observed that a significant percentage of downregulated transcripts identified in miR-16 transfected cells contained at least one, and often two, sequences corresponding to the miR-16 consensus seed sequence.

Once a plurality of regulated genes are identified that comprise at least one microRNA responsive target site, a plurality of members of the set of genes are modulated in the cell type of interest with a plurality of gene-specific agents. The gene-specific agents are designed to specifically modulate (either increase or decrease expression of) the identified microRNA-responsive genes to determine whether inhibition (or overexpression) of the individual genes targeted, either alone or in combination, produces the same expression pattern or phenotype as the corresponding microRNA. In other words, the set of identified micro-RNA responsive genes are individually targeted to see if when modulated, alone or in combination, one or more phenotypes observed in the microRNA modulated cells are phenocopied.

The gene-specific agents used to modulate the identified micro-RNA-responsive genes may be any suitable agonist or antagonist of the identified gene. As a non-limiting illustrative example, in the case where a selected microRNA species was transfected into a cell type of interest, a set of microRNA-responsive genes are identified that exhibit decreased expression, and a plurality of gene-specific inhibitory agents directed against the identified set of genes would be chosen to transfect into the cell type of interest. The phenotype of the microRNA transfected cells and the inhibitory gene-specific agent transfected cells would then be compared for the presence of at least one shared phenotype.

Gene-specific agents designed to inhibit a gene of interest include RNA inhibitors such as antisense oligonucleotides, iRNA agents, and protein inhibitors, such as antibodies, soluble receptors, and the like. IRNA agents encompass any RNA agent which can downregulate the expression of a target gene, including siRNA molecules and shRNA molecules. The siRNA molecules may be designed to inhibit a particular target gene by using an algorithm developed to increase efficiency of the siRNAs for silencing while minimizing their off-target effects, as described in Jackson et al., *Nat Biotech* 21:635-637 (2003), WO2006006948, and WO2005/042708, incorporated herein by reference. As described in Jackson et al., *RNA* 12: 1197-1205 (2006), incorporated herein by reference, and also in U.S. Patent Publication No. 20050223427, incorporated herein by reference, 2'-O-methyl modifications to specific positions within the siRNA seed region (e.g., at positions 1-5) reduce both the number of off-target transcripts and the magnitude of their regulation, while not significantly affecting silencing of the intended targets. In particular, it was observed by *Jackson* et al. (2006), that 2'-O-methyl ribosyl substitution in the siRNA at position 1, position 2, or positions 1+2 of the seed region were effective to reduce the off-target transcript down-regulation whiel regulation of the intended target was unaffected. The addition of O-methyl groups to the 2' position of the ribosyl ring may be carried out using techniques known in the art, and is commonly used for RNA modification to alter thermodynamic and binding properties of modified duplexes. See e.g., Monia et al., *J. Biol. Chem.* 268: 14514-14522 (1993).

Exemplary siRNA sequences designed to target miR-16 downregulated transcripts are provided below in TABLE 9.

The microRNA, and iRNA agents (including shRNA, and siRNA molecules) for use in the practice of the methods of the invention and to produce the compositions of the invention may chemically synthesized or recombinantly produced using methods known in the art. for example, the RNA products may be chemically synthesized using appropriately protected ribonucleoside phosphoramidites and a conventional DNA/RNA synthesizer. Commercial suppliers of synthetic RNA molecules or synthesis reagents include Proligo (Hamburg Germany) and Dharmacon Research (Lafayette, Colo.). Exemplary microRNA molecules that may be used to practice various embodiments of the methods of this aspect of the invention are provided in TABLE 1 and TABLE 7.

In one embodiment, the invention provides chemically modified siRNA constructs designed to target miR-16 responsive targets. For example, the siRNA agent can include a non-nucleotide moiety. A chemical modification or other non-nucleotide moiety can stabilize the sense (guide strand) and antisense (passenger strand) sequences against nucleolytic degradation. Additionally, conjugates can be used to increase uptake and target uptake of the siRNA agent to particular cell types. Thus, in one embodiment the siRNA agent includes a duplex molecule wherein one or more sequences of the duplex molecule is chemically modified. Non-limiting examples of such chemical modifications include phosphorothioate internucleotide linkages, 2'-deoxyribonucleotides, 2'-O-methyl ribonucleotides, 2'-deoxy-2'-fluoro ribonucleotides, "universal base" nucleotides, "acyclic" nucleotides, 5'-C-methyl nucleotides, and terminal glyceryl and/or inverted deoxy abasic residue incorporation. These chemical modifications, when used in siRNA agents, can help to preserve RNAi activity of the agents in cells and can increase the serum stability of the siRNA agents.

In one embodiment, the first and optionally or preferably the first two internucleotide linkages at the 5' end of the antisense and/or sense sequences are modified, preferably by a phosphorothioate. In another embodiment, the first, and perhaps the first two, three, or four internucleotide linkages at the 3' end of a sense and/or antisense sequence are modified, for example, by a phosphorothioate. In another embodiment, the 5' end of both the sense and antisense sequences, and the 3' end of both the sense and antisense sequences are modified as described.

Alternatively, microRNA gene products and IRNA agents can be expressed from recombinant circular or linear DNA plasmids using any suitable promoter. Suitable promoters for expressing RNA from a plasmid include the U6 or H1 RNA polIII promoter sequences, or the cytomegalovirus promoters. Selection of other suitable promoters is within the skill in the art. The recombinant plasmids of the invention can also comprise inducible or regulatable promoters for expression of the microRNA or IRNA agent gene products in a desired cell type. For example, a vector may be designed to drive expression (e.g., using the PolIII promoter) of both the sense and antisense strands seperately, which hybridize in vivo to generate siRNA.

In one embodiment, the iRNA agent is an shRNA. A vector may be used to drive expression of short hairpin RNA (shRNA), which are individual transcripts that adopt stem-loop structures, which are processed into siRNAs by the RNAi machinery in the cell. Typically, the shRNA design comprises two inverted repeats containing the sense and antisense target sequence separated by a loop sequence. Typically, the loop sequence contains 8 to 9 bases. A terminator sequence consisting of 5-6 polydTs is present at the 3' end and one or more cloning sequences may be added to the 5' end using complementary oligonucleotides. A website is available for design of such vectors, see, http://www.genelink.com/sirna/shRNAhelp.asp.

An shRNA vector may be designed with an inducible promoter. For example, a lentiviral vector may be used expressing tTS (tetracycline-controlled transcriptional repressor, Clontech). For example, a tetracycline-inducible shRNA designed to target a gene, such as PLK1 may be driven from an H1 promoter, as described in Jackson et al., *RNA* 12:1-9 (2006). The cells of interest are infected with recombinant lentivirus and shRNA expression is induced by incubation of the cells in the presence of 50 ng/mL of doxycycline.

In some embodiments, the method of this aspect of the invention further comprises the step of comparing the set of identified microRNA responsive transcripts to a source of biological knowledge to identify a plurality of microRNA responsive transcripts that are enriched in a known biological pathway or process. As used herein, the term "source of biological knowledge" refers to information that describes the function (e.g., at molecular, cellular and system levels), structure, pathological roles, toxicological implications, etc., of a multiplicity of genes. Various sources of biological knowledge can be used for the methods of the invention, including databases and information collected from public sources such as Locuslink, Unigene, SwissTrEMBL, etc., and organized into a relational database following the concept of the central dogma of molecular biology.

In some embodiments, the annotation systems used by the Gene Ontology (GO) Consortium or similar systems are employed. GO is a dynamic controlled vocabulary for molecular biology which can be applied to all organisms as knowledge of gene is accumulating and changing; it is developed and maintained by Gene Ontology™ Consortium (*Gene Ontology*: Tool for the unification of biology. The Gene Ontology Consortium (2000) *Nature Genet.* 25:25-29). Gene annotations using GO terms provide an excellent resource for summarized knowledge on each gene. Genes with similar biological property are annotated with the same or similar GO terms and thus can be easily identified. Currently, there are three categories of GO terms: biological processes, molecular function, and cellular component. For example, the Degenerin gene is annotated with "peripheral nervous system development," "monovalent inorganic cation transport," "central nervous system development," and "synaptic transmission" for biological process, "amiloride-sensitive sodium channel" for molecular function, and "integral plasma membrane protein" for cellular component.

GO cluster algorithm may be employed in computer implemented methods to automatically cluster genes based upon existing knowledge. One of skill in the art may determine that a correlation (positive or negative) exists between the expression pattern of the microRNA-modulated cells and the enrichment of regulated (i.e. responsive) transcripts in an identified biological pathway using GO terms.

In accordance with the methods of this aspect of the invention, the cells that are seperately modulated with a plurality of gene-specific agents directed against different identified miRNA responsive genes are analyzed for the presence of at least one phenotype of interest that is also displayed by cells modulated with the corresponding microRNA. The shared phenotype may be any measurable effect, or combination of measurable effects, including cellular phenotypes and expression phenotypes. For example, a phenotype can be determined with reference to stimulation, and/or inhibition, of one or more biological responses; and/or the absolute and/or relative magnitude of stimulation, and/or inhibition, of one, or more, biological responses; and/or the inability to affect (e.g., the inability to stimulate or inhibit) one, or more, biological responses. Non-limiting examples of measurable biological processes include biochemical pathways; physiological processes that contribute to the internal homeostasis of a living organism; developmental processes that contribute to the normal physical development of a living organism; and acute or chronic diseases. For example, cellular morphology may be analyzed using automated fluorescence microscopy to visualize actin filaments, microtubules and DNA, in order to detected morphological cellular phenotypes. In some embodiments, a phenotype may be measurable by performing gene or protein expression analysis on a set of predetermined transcripts or proteins. For example, a cell cycle phenotype may be measured by analyzing cell cycle progression as described in EXAMPLE 4.

In one embodiment of the method, the phenotype is a gene expression pattern induced by modulating the microRNA. In accordance with this embodiment, a gene expression profile for cells transfected with each of a plurality of the gene-specific agents targeting a plurality of microRNA responsive transcript are compared to the microRNA transfected cell profile. The gene expression patterns triggered by the microRNA and each gene-specific agent targeting a microRNA responsive transcript are statistically analyzed to identify the subset of genes that share the phenotype of triggering a similar expression profile in the cell type of interest.

In another embodiment of the method, a cellular phenotype is observed in transfected cells, such as a cell cycle regulatory phenotype. For example, the transfected cells can be analyzed for various properties such as viability and cell cycle distribution at various time points, as described in more detail in EXAMPLE 4.

In accordance with some embodiments, the step of comparing the down-regulated transcripts to a source of biological knowledge to identify a plurality of down-regulated transcripts that are enriched in a known biological pathway or process is used to select a suitable phenotype for use in the method of the invention. It will be appreciated by those of skill in the art that the method of the invention is not limited to a particular sequence of steps described herein, but may be practiced using the described steps in a different order, and/or with the addition or elimination of certain steps.

The methods of this aspect of the invention have been used to identify a subset of genes that are responsive to miR-16 and share a cell cycle phenotype, as described in more detail in EXAMPLES 1-7 and FIGS. 1-8.

In another aspect, the present invention provides a method of inhibiting proliferation of a mammalian cell comprising introducing into said cell an effective amount of at least one small interfering RNA agent (iRNAi), wherein said iRNA comprises a nucleotide sequence of at least 15 nucleotides, wherein the nucleotide sequence comprises a seed region consisting of nucleotide positions 1 to 12, wherein position 1 represents the 5' end of the iRNA nucleotide sequence and wherein said seed region comprises a nucleotide seqeuence of at least six contiguous nucleotides that is complementary to six contiguous nucleotides located within positions 1 to 12 of a nucleotide sequence (including position 1 and position 12), wherein position 1 represents the 5' end of the nucleotide sequence, wherein the nucleotide sequence is selected from the group consisting of SEQ ID NO: 1, SEQ ID NO:2, SEQ ID NO:3, SEQ ID NO:4, SEQ ID NO:5, SEQ ID NO:6, SEQ ID NO:7 and SEQ ID NO:8.

In some embodiments, the nucleotide sequence is within positions 1 to 12 of SEQ ID NO:1. In some embodiments, the nucleotide sequence is within positions 1 to 12 of SEQ ID NO:2. In some embodiments, the nucleotide sequence is within positions 1 to 12 of SEQ ID NO:3. In some embodiments, the nucleotide sequence is within positions 1 to 12 of SEQ ID NO:4. In some embodiments, the nucleotide sequence is within positions 1 to 12 of SEQ ID NO:5. In some embodiments, the nucleotide sequence is within positions 1 to 12 of SEQ ID NO:6. In some embodiments, the nucleotide sequence is within positions 1 to 12 of SEQ ID NO:7. In some embodiments, the nucleotide sequence is within positions 1 to 12 of SEQ ID NO:8.

In some embodiments, the iRNA is a gene-specific inhibitor of expression of at least one miR-16 responsive gene selected from TABLE 5. In some embodiments, the method comprises introducing an effective amount of an iRNA that inhibits expression of at least two miR-16 responsive genes selected from TABLE 5 into the mammalian cell. In some embodiments, the method comprises introducing an effective amount of at least one iRNA that inhibits expression of at least one miR-16 responsive gene selected from TABLE 6 into the mammalian cell.

In some embodiments, the at least one miR-16 response gene is selected from the group consisting of ATG9A, ATXN7L3, C10orf46, IPPK, C9orf42, C9orf91, CARD10, CBX6, CDC27, CDK6, COX10, H2AFX, KIAA0317, MFN2, PHF17, PPP1R11, RAB11FIP2, and SRPR. In some embodiments, the method comprises introducing a composition comprising an effective amount of a combination of iRNA agents, such as nucleic acid molecules that inhibit at least two or more miR-16 responsive targets selected from the group consisting CARD10, CDC27, CDK6 and C10orf46.

The methods of this aspect of the invention may be used to inhibit proliferation of a cancer cell, such as an miR-16 mediated cancer cell, such as CLL or prostate cancer cells. The methods of this aspect of the invention may also be used to inhibit proliferation of a mammalian cell infected with a virus expressing a microRNA species in the miR-16 family, such as, for example, a cell infected with kshv-miR-K12-6-5p.

In some embodiments, the iRNA agents are selected from the group consisting of siRNA molecules and shRNA molecules. Exemplary siRNA molecules useful in the practice of the method of the invention are provided in TABLE 8 and TABLE 10. In some embodiments, the siRNA molecules comprise at least one dsRNA molecule comprising one nucleotide strand that is substantially identical to a portion of the mRNA encoding a gene listed in TABLE 6, such as, for example, CDK6, CDC27, CARD10 and C10orf46. In one particular embodiment, the gene-specific agent of at least one miR-16 responsive gene is at least one dsRNA molecule comprising a double-stranded region, wherein one strand of the double-stranded region is substantially identical to 15 to 25 consecutive nucleotides of an mRNA encoding a gene set forth in TABLE 6, and the second strand is substantially complementary to the first, and wherein at least one end of the dsRNA has an overhang of 1 to 4 nucleotides.

In one embodiment, the iRNA agent comprises at least one of SEQ ID NO:272-277, SEQ ID NO:284-289, SEQ ID NO:290-295, SEQ ID NO:248-253, SEQ ID NO:344-349, SEQ ID NO:350-355, SEQ ID NO:356-361.

The siRNAs useful in the methods of the invention may be chemically synthesized and annealed before delivery to a cell or mammalian subject, as described supra. In some embodiments, the siRNAs are synthesized in vivo, such as from a plasmid expression system (see, e.g., Tuschl and Borkhardt, *Molec Interventions* 2:158-167 (2002)). Exemplary constructs for making dsRNAs are described, for example, in U.S. Pat. No. 6,573,099. In some embodiments, the siRNA or shRNA inhibitory molecules inhibit expression of a target gene by at least 30%, such as 50%, such as 60%, such as 80%, such 90% up to 100%.

The siRNA and shRNA molecules can be delivered into cells in culture using electroporation or lipophilic reagents. The siRNA molecules can be delivered into a mammalian subject, for example, by intravenous injection, direct injection into a target site (e.g., into tumors), or into mice or rats by high-pressure tail-vein injection. It has been demonstrated that synthetic siRNAs can silence target gene expression in mammalian models. For example, McCaffrey et al. (*Nature* 418:38-39 (2002)), described silencing of a reporter gene in mice when the reporter gene and siRNA were injected simultaneously by high-pressure tail vein injections. Moreover, Soutsched et al. (*Nature* 432:173-178 (2004)) demonstrated that a synthetic siRNA downregulated expression of an endogenous target gene following intravenous injection in mice. Similarly, Pulukuir et al. (*J. Biol. Chem* 280:36529-36540 (2005)), demonstrated that injection of plasmids expressing short hairpin RNAs (shRNAs) into tumors in mice downregulated expression of the target gene in the tumors and also caused a decrease in tumor weight.

In another aspect, the present invention provides compositions comprising a combination of nucleic acid molecules that are useful as inhibitors of at least two or more miR-16 responsive targets selected from TABLE 5 or TABLE 6. In some embodiments, the compositions comprise a combination of nucleic acid molecules that are useful as inhibitors of at least two or more miR-16 responsive targets selected from the group consisting of ATG9A, ATXN7L3, C10orf46, IPPK, C9orf42, C9orf91, CARD10, CBX6, CDC27, CDK6, COX10, H2AFX, KIAA0317, MFN2, PHF17, PPP1R11, RAB11FIP2, and SRPR. In some embodiments, the compositions comprise a combination of nucleic acid molecules that are useful as inhibitors of at least two or more coordinately regulated miR-16 responsive targets selected from the group consisting CARD10, CDC27, CDK6 and C10orf46.

In another aspect, the present invention provides an isolated dsRNA molecule comprising one nucleotide strand that is substantially identical to a sequence selected from the group consisting of SEQ ID NO:236 to SEQ ID NO:361. In some embodiments, the isolated dsRNA molecule comprises at least one of SEQ ID NO:236 to SEQ ID NO: 361. In some embodiments, at least one strand of the isolated dsRNA molecule consists of at least one of SEQ ID NO:236 to SEQ ID NO:361.

In another embodiment, pharmaceutical compositions comprising nucleic acid molecules that inhibit at least one miR-16 responsive target are provided. Such a composition contains from about 0.01 to 90% by weight (such as 1 to 20% or 1 to 10%) of a therapeutic agent of the invention in a pharmaceutically acceptable carrier. Solid formulations of the compositions for oral administration may contain suitable carriers or excipients, such as corn starch, gelatin, lactose, acacia, sucrose, microcrystalline cellulose, kaolin, mannitol, dicalcium phosphate, calcium carbonate, sodium chloride, or alginic acid. Liquid formulations of the compositions for oral administration prepared in water or other aqueous vehicles may contain various suspending agents such as methylcellulose, alginate, tragacnth, pectin, kelgin, carrageenan, acacia, polyvinylpyrrolidone, and polyvinyl alcohol.

Injectable formulations of the compositions may contain various carriers such as vegetable oils, dimethylacetamide, dimethylformamide, ethyl lactate, ethyl carbonate, isopropyl myristate, ethanol, polyols (glycerol, propylene glycol, liquid polyethylene glycol and the like). For intravenous injections, water soluble versions of the compounds may be administered by the drip method, whereby a pharmaceutical formulation containing an antifungal agent and a physiologically acceptable excipient is infused. Physiologically acceptable excipients may include, for example, 5% dextrose, 0.9% saline, Ringer's solution, or other suitable excipients. Intramuscular preparations, e.g., a sterile formulation of the compounds of the invention can be dissolved and administered in a pharmaceutical excipient was as water-for-injection, 0.9% saline, or 5% glucose solution.

Conventional methods, known to those of ordinary skill in the art of medicine, can be used to administer the pharmaceutical formulations to a mammalian subject. The pharmaceutical formulations can be administered via oral, subcutaneous, intrapulmonary, transmucosal, intraperitoneal, intrauterine, sublingual, intrathecal or intramuscular routes.

The following examples merely illustrate the best mode now contemplated for practicing the invention, but should not be construed to limit the invention. All literature citations are expressly incorporated by reference.

EXAMPLE 1

This Example describes a method of using microarray expression profiling of cells transfected with a panel of microRNAs duplex molecules to identify microRNA responsive targets that are coordinately down-regulated.

Methods and Materials:

24 microRNAs were selected for transfection, as shown below in TABLE 1.

TABLE 1

| microRNAs Transfected (panel of 24) | | |
|---|---|---|
| miRNAs | Sense sequence | Antisense sequence |
| miR-103 | AGCAGCAUUGUACAGGGCUAUGA (SEQ ID NO: 16) | AUAGCCCUGUACAAUGCUGGUAU (SEQ ID NO: 17) |
| miR-106b | UAAAGUGCUGACAGUGCAGAU (SEQ ID NO: 18) | CUGCACUGUCAGCACUUUAAU (SEQ ID NO: 19) |
| miR-133a | UUGGUCCCCUUCAACCAGCUGU (SEQ ID NO: 20) | AGCUGGUUGAAGGGGAUUAAAU (SEQ ID NO: 21) |
| miR-141 | AACACUGUCUGGUAAAGAUGG (SEQ ID NO: 22) | AUCUUUACCAGACAGUGAUAU (SEQ ID NO: 23) |
| miR-145 | GUCCAGUUUUCCCAGGAAUCCCUU (SEQ ID NO: 24) | GGGAUUCCUGGGAAAACUGGUCAU (SEQ ID NO: 25) |
| miR-155 | UUAAUGCUAAUCGUGAUAGGGG (SEQ ID NO: 26) | CCUAUCACGAUUAGCAUUAAAU (SEQ ID NO: 27) |
| miR-15a | UAGCAGCACAUAAUGGUUUGUG (SEQ ID NO: 28) | CAAACCAUUAUGUGCUGCAAAU (SEQ ID NO: 29) |
| miR-16 | UAGCAGCACGUAAAUAUUGGCG (SEQ ID NO: 30) | CCAAUAUUUACGUGCUGCAAAU (SEQ ID NO: 31) |
| miR-17-3p | ACUGCAGUGAAGGCACUUGU (SEQ ID NO: 32) | AAGUGCCUUCACUGCACUAU (SEQ ID NO: 33) |
| miR-17-5p | CAAAGUGCUUACAGUGCAGGUAGU (SEQ ID NO: 34) | UACCUGCACUGUAAGCACUUAGAU (SEQ ID NO: 35) |
| miR-18 | UAAGGUGCAUCUAGUGCAGAUA (SEQ ID NO: 36) | UCUGCACUAGAUGCACUUUAAU (SEQ ID NO: 37) |
| miR-192 | CUGACCUAUGAAUUGACAGCC (SEQ ID NO: 38) | CUGUCAAUUCAUAGGUCUGAU (SEQ ID NO: 39) |
| miR-194 | UGUAACAGCAACUCCAUGUGGA (SEQ ID NO: 40) | CACAUGGAGUUGCUGUUAGAAU (SEQ ID NO: 41) |
| miR-19a | UGUGCAAAUCUAUGCAAAACUGA (SEQ ID NO: 42) | AGUUUUGCAUAGAUUUGCAGAAU (SEQ ID NO: 43) |
| miR-19b | UGUGCAAAUCCAUGCAAAACUGA (SEQ ID NO: 44) | AGUUUUGCAUGGAUUUGCAGAAU (SEQ ID NO: 45) |
| miR-200a | UAACACUGUCUGGUAACGAUGU (SEQ ID NO: 46) | AUCGUUACCAGACAGUGUAAAU (SEQ ID NO: 47) |
| miR-200b | CUCUAAUACUGCCUGGUAAUGAUG (SEQ ID NO: 48) | UCAUUACCAGGCAGUAUUAGUGAU (SEQ ID NO: 49) |
| miR-20a | UAAAGUGCUUAUAGUGCAGGUA (SEQ ID NO: 50) | CCUGCACUAUAAGCACUUUAAU (SEQ ID NO: 51) |
| miR-21 | UAGCUUAUCAGACUGAUGUUGA (SEQ ID NO: 52) | AACAUCAGUCUGAUAAGCAAAU (SEQ ID NO: 53) |
| miR-215 | AUGACCUAUGAAUUGACAGAC (SEQ ID NO: 54) | CUGUCAAUUCAUAGGUCUUAU (SEQ ID NO: 55) |
| miR-221 | AGCUACAUUGUCUGCUGGGUUUC (SEQ ID NO: 56) | AACCCAGCAGACAAUGUAGGUAU (SEQ ID NO: 57) |
| miR-25 | CAUUGCACUUGUCUCGGUCUGA (SEQ ID NO: 58) | AGACCGAGACAAGUGCAAAGAU (SEQ ID NO: 59) |
| miR-92 | UAUUGCACUUGUCCCGGCCUGU (SEQ ID NO: 60) | AGGCCGGGACAAGUGCAAUAAU (SEQ ID NO: 61) |

TABLE 1-continued microRNAs Transfected (panel of 24)

| miRNAs | Sense sequence | Antisense sequence |
|---|---|---|
| miR-93 | AAAGUGCUGUUCGUGCAGGUAG (SEQ ID NO: 62) | ACCUGCACGAACAGCACUUUAU (SEQ ID NO: 63) |
| kshv-miR-K12-6-5p | CCAGCAGCACCUAAUCCAUCGG (SEQ ID NO: 64) | GAUGGAUUAGGUGCUGCUCGAU (SEQ ID NO: 65) |
| kshv-miR-K12-3 | UCACAUUCUGAGGACGGCAGCG (SEQ ID NO: 66) | CUGCCGUCCUCAGAAUGUCAAU (SEQ ID NO: 67) |

Cell lines: Each of the 24 different miRNAs listed in TABLE 1 were transfected into HCT116 Dicer$^{ex5}$ and DLD-1 Dicer$^{ex5}$ colon tumor cells described in Cummins, J. M., et al. (PNAS 103(10):3687-3692 (2006)). Briefly described, these colon cancer tumor cell lines have homozygous disruption of the Dicer helicase domain and show reduced levels of many endogenous miRNAs (Cummins, supra). A preliminary set of experiments were carried out in matched Dicer wild type cells. It was observed that the Dicer homomorphs showed substantially similar expression patterns, with approximately 2-fold more intense expression changes following transfection of exogeneous siRNA/miRNAs than matched Dicer wild type cells (data not shown), therefore, the Dicer$^{ex5}$ cells were used for subsequent experiments. Wild type HCT116, DLD-1, HeLa, A549, MCF7, and TOV21G cells were obtained from the ATCC, Rockville, Md.

RNA Duplexes: RNA duplexes corresponding to mature miRNAs were designed as described in Lim, L. P., et al., Nature 433(7027):769-73 (2005), incorporated herein by reference. The miRNA duplexes used in this study are shown in TABLE 1. miRNA duplexes were ordered and produced by Dharmacon (Lafayette, Colo.).

Transfections: For miRNA transfections, cells were plated 24 hours prior to transfection. HCT116 cells were transfected in 6 well plates using Lipofectamine 2000 (Invitrogen, Carlsbad, Calif.). DLD-1, HeLa, TOV21G and A549 cells were transfected using SilentFect (Bio-Rad, Hercules, Calif.). MCF7 cells were transfected using Oligofectamine (Invitrogen, Carlsbad, Calif.). miRNA duplexes were annealed and were individually transfected at a final concentration of 25 nM for all cell lines except for HCT166, where concentration of 100 nM was used. Semi-automated 384 well transfections were carried out as described in Bartz et al., submitted.

Microarray Analysis: Total RNA was isolated from transfected cells 24 hours post transfection. Total RNA was purified using an RNAeasy kit (Qiagen). cRNA amplification and microarray analysis was performed as described in Hughes et al., Nat Biotech 19:342-347 (2001), incorporated herein by reference. Amplified cRNA from miRNA-transfected cells was hybridized against cRNA from mock-transfected cells (treated with transfection reagent in the absence of RNA duplex). Ratio hybridizations were performed with fluorescent label reversal to eliminate dye bias. Expression profile analysis and statistical error models were used as described in Hughes et al., supra. Data were analyzed using Rosetta Resolver™ (Rosetta Biosoftware, Seattle, Wash.).

Identification of Downregulated Transcripts: Gene expression profiles were determined at 24 hours post-transfection by competitive hybridization of amplified RNA from miRNA-transfected HCT116Dicer$^{ex5}$ cells and DLD-1 Dicer$^{ex5}$ cells versus mock treated cells. The 24 hour time point was chosen because it has been shown that by 24 hours mRNA silencing is maximal, but secondary transcription effects due to protein depletion are generally minimal (see Jackson et al., Nat. Biotech. 21:635-637 (2003)). Expression profiles were analyzed from the two individual cell lines transfected with each miRNA, and also as a union, or intersection of profiles from the two transfected cell lines. The intersection signature (p<0.01) between the HCT116Dicer$^{ex5}$ cells and DLD-1 Dicer$^{ex5}$ transfected cell lines was identified. It was determined that the intersection signatures yielded a more consistent set of targets, likely due to the cancellation of artifacts in the hybridization data. A collection of miRNA downregulated transcripts (p<0.05) was defined by the intersection of down-regulated transcripts from two different Dicer$^{ex5}$ cell lines.

Results of Microarray analysis: Transcripts that were downregulated after transfection with miRNA were identified in microarray gene expression data as downregulated transcripts using a P value cut-off (P<0.05). It was observed that transfection of miRNAs sharing seed region identity resulted in patterns of downregulated transcripts were largely unique to a family of miRNAs sharing identity in residues 1-12 of the miRNA guide strand (seed region). For example, nearly identical expression profiles were obtained for the following miRNA species: (1) miR-15a (SEQ ID NO:1), miR-16 (SEQ ID NO:3), and miR-103 (SEQ ID NO:4), (2) miR-17-5p (SEQ ID NO:9), miR-20a (SEQ ID NO:10), (3) miR-141 (SEQ ID NO: 12) and miR-200a (SEQ ID NO: 13) and (4) miR-192 (SEQ ID NO: 14) and miR-215 (SEQ ID NO: 15). The seed region sequence for the exemplary miRNAs listed above is shown in TABLE 2 and FIG. 2.

With regard to miR-15a (SEQ ID NO:1), miR15b (SEQ ID NO:2) and miR-16 (SEQ ID NO:3), it was determined that this set of miRNA species share an identical hexamer seed region (e.g., a stretch of 6 contiguous bases complementary to a seed region of nucleotide 1-6, 2-7, or 3-8), and were designated as an "miR-16 family." It was interesting to note that miR-103 (SEQ ID NO:4) gave an overlapping, but distinct profile from miR-15a and miR-16 (data not shown). As shown in FIG. 2 and TABLE 2, miR-103 contains a seed sequence that is offset by 1 nucleotide from that of miR-15a and miR-16. Therefore, it appears that a small difference in the seed region may affect miRNA target recognition.

miRNA Downregulated Gene Set Analysis:

The set of miRNA downregulated transcripts identified by microarray analysis were then tested for enrichment with respect to the presence of 1) one or more miRNA hexamer seed regions in the 3' UTR (i.e., a stretch of 6 contiguous bases complementary to a seed region nt 1-6, 2-7, or 3-8) corresponding to one of the miRNA species in the set of transfected miRNAs, and/or 2) transcript annotation information regarding the biological function of the transcript, for example, annotation of a transcript in the public Gene Ontology Biological Process database. The Gene Ontology Biological Process database provides structure controlled Gene Ontologies (GO) that describe gene products in terms of their associated biological processes, cellular components, and molecular functions in a species-independent manner. The categories of GO terms include biological processes, molecular function, and cellular components. The Gene Ontology (GO) Database is maintained by the Gene Ontology Consortium (2000), *Nature Genet.* 25:25-29 (2000).

Analysis of miRNA Downregulated Gene Set for miRNA Targets

The transcripts that were found to be downregulated were examined for the presence of one or more seed hexamer matches in a 3' UTR corresponding to one of the miRNA species transfected into the cells relative to a background set of genes on the microarray using a hypergeometric distribution (see, e.g., Benjamini, Y. & Hochberg, Y. (1995), *J.R. Stat. Soc. B* 57:289-300). 23 of the 24 miRNA downregulated intersection signatures showed enrichment for seed region hexamers, a result that is highly unlikely to occur by chance (E<1E-20). The family-specific transcripts were highly enriched for hexamer sequence motifs complementary to (matching) the seed region for that family (data not shown). It was also determined that the downregulated signatures were significantly enriched with respect to computationally predicted miRNA targets (Krek et al., *Nat. Genet.* 37:495-500 (2005); Xie et al., *Nature* 434:338-345 (2005)), confirming that the miRNA transfections were largely successful.

TABLE 2

| microRNA | Target Sequence | SEQ ID NO: |
|---|---|---|
| hsA-miR-15a | *UAGCAGCA*CAUAAUGGUUUGUG | 1 |
| hsa-miR-15b | *UAGCAGCA*CAUCAUGGUUUACA | 2 |
| hsa-miR-16 | *UAGCAGCA*CGUAAAUAUUGGCG | 3 |
| hsa-miR-103 | *AGCAGCAU*UGUACAGGGCUAUGA | 4 |
| hsa-miR107 | *AGCAGCAU*UGUACAGGGCUAUCA | 5 |
| hsa-miR195 | *UAGCAGCA*CAGAAAUAUUGGC | 6 |
| kshv-miR-K12-6-5p | *CCAGCAGC*ACCUAAUCCAUCGG | 7 |
| consensus miR-16 family seed sequence | *UAGCAGCA* | 8 |
| miR-17-5p | *CAAAGUGC*UUACAGUGCAGGUAGU | 9 |
| miR-20a | *UAAAGUGC*UUAUAGUGCAGGUAG | 10 |
| miR-106b | *UAAAGUGC*UGACAGUGCAGAU | 11 |
| miR-141 | *UAACACUG*UCUGGUAAAGAUGG | 12 |
| miR-200a | *UAACACUG*UCUGGUAACGAUGU | 13 |
| miR-192 | *CUGACCUA*UGAAUUGACAGCC | 14 |
| miR-215 | *AUGACCUA*UGAAUUGACAGAC | 15 | seed region is in italics (residues 1-8)

TABLE 3

Hexamer Analysis

| | Total Transcripts Screened | Number of Transcripts Down-regulated | Number and % Downregulated Targets With Corresponding MiR Seed Hexamer | E Value |
|---|---|---|---|---|
| MiR-16 | 18,124 | 557 | 47% (261) | 8.9E-46 |
| MiR-15a | 18,124 | 549 | 49% (269) | 6.5E-51 |
| MiR-103 | 18,124 | 215 | 52% (111) | 6.7E-22 |

Results of Seed Analysis: The downregulated transcripts were analyzed for enrichment of hexamer motifs complementary to the miRNA seed region in their 3' UTRs. TABLE 3 shows the data for the miRNA-16 family including miR-103, miR-15a, and miR-16. Of the total 18,124 total transcripts on the microarray, 641 transcripts were identified that were downregulated and contained at least one miR-16 seed region in the 3'UTR.

The miR-16 family of transcripts was further analyzed with regard to timing of transcript downregulation and number of hexamer seed regions present in the 3' UTR< as described in more detail in EXAMPLE 2. Transcripts in the intersection signature that were also regulated (p<0.05) at 6 hours in HCT Dicer$^{ex5}$ cells were defined as miR-16 consensus downregulated transcripts (N=116), as described in EXAMPLE 2.

Biological Annotation Analysis: The set of miRNA downregulated transcripts identified by microarray analysis were also analyzed to determine if they were enriched for transcripts associated with known biological pathways or processes. A search was done with the transcripts identified in the microarray analysis against the GO Biological Database for correlation between a set of transcripts downregulated with a particular miRNA species and a GO process term.

TABLE 4

Biological Annotation

| | Total Transcripts Screened | Number of Transcripts Downregulated | Number and % Annotated With Highest Ranking Biological Process Term From GO Terms | E Value |
|---|---|---|---|---|
| MiR-16 | 18,124 | 557 | Cell cycle: 22% (122) | 2.3E-30 |
| MiR-15a | 18,124 | 549 | Mitotic cell cycle: 14% (76) | 3.0E-32 |
| MiR-103 | 18,124 | 215 | Mitotic cell cycle: 12% (25) | 2.4E-06 |

Results: It was observed that 3 of the 24 miRNAs used for transfection, miR-16, miR-15a, and miR-103 downregulated a set of transcripts that showed a significant correlation (E<1E-2) for transcripts associated with a GO Biological Process term, as shown above in TABLE 4. It is interesting to note that miR-16, miR-15a, and miR-103 are all from the miR-16 family, as shown in FIG. 2 and TABLE 2. Of the total 18,124 total transcripts on the microarray, 233 transcripts were identified that were downregulated and contained a correlation with the GO term "cell cycle".

The set of transcripts downregulated in transfections with miR-16, miR-15a and miR-103 were found to be significantly enriched for transcripts annotated with GO process terms "mitotic cell cycle" or "cell cycle," as shown below in TABLE 4. It was observed that the degree of functional enrichment in miR-103 signatures was less significant than with miR-15a and miR-16. This is consistent with the finding that the gene expression signature resulting from miR-103 transfection overlaps with, but is distinct from, the miR-15a and miR-16 signature, and that the miR-103 seed region is offset by 1 nucleotide, as described above and shown in FIG. 2.

EXAMPLE 2

This Example describes a kinetic analysis of transcript regulation after transfection with RNA duplexes for miR-16 family members miR-15a, miR-106b, and miR-16 and analysis of miR-16 downregulated transcripts for the presence of miRNA responsive target sites.

Rationale: The miRNA responsive target site analysis and transcript annotation described in EXAMPLE 1 suggested that transcripts regulated by miR-15a, miR-16, and to some extent miR-103 are involved in regulation of the cell cycle and/or cell growth. Both mitotic cell cycle transcripts and putative targets of miR-15a and miR-16 were found to be enriched in the 24-hr down-regulated signatures. In order to distinguish transcripts directly regulated or indirectly regulated by the miR-16 family, a kinetic analysis of transcript regulation was carried as described below.

Methods: HCT116Dicer$^{ex5}$ and DLD-1Dicer$^{ex5}$ cells were transfected with miR-106b, miR-16, and miR-15a duplexes, as described in EXAMPLE 1. RNA samples were isolated from the transfected cells at 0, 6, 10, 14, and 24 hours after transfection and were compared to RNA from mock-transfected cells. Gene expression signatures were determined at each time point using microarray expression analysis as described in EXAMPLE 1.

In a separate experiment, miR-16 was transfected into HCT116 wt (colon cancer), DLD-1wt (colon cancer), A549 (lung cancer), MCF7 (breast cancer), and TOV21G (ovarian cancer) cells. Wild type HCT116, DLD-1, HeLa, A549, MCF7, and TOV21G cells were obtained from the ATCC, Rockville, Md. Transfections were carried out as described in EXAMPLE 1. HCT116 cells were transfected in 6 well plates using Lipofectamine 2000 (Invitrogen, Carlsbad, Calif.). DLD-1, HeLa, and A549 cells were transfected using Silent-Fect (Bio-Rad, Hercules, Calif.). MCF7 and TOV21G cells were transfected using Oligofectamine (Invitrogen, Carlsbad, Calif.). miRNA duplexes were individually transfected at a final concentration of 25 nM for all cell lines except for HCT166, where concentration of 100 nM was used.

Results: FIG. 3 is a heatmap representation of gene expression in HCT116Dicer$^{ex5}$ cells after transfection with miR-15a, miR-16, or miR-106b duplexes. RNA samples were isolated 0, 6, 10, 14 and 24 hours after transfection and were compared to RNA from mock-transfected cells. Shown in FIG. 3 are 1394 transcripts selected to have p<0.05 and $\log_{10}$ expression ratio<0 in any one experiment. The regulated transcripts (columns) at different time points (rows) are shown for the luciferase control, miR-106b, miR-15a and miR-16. Samples are arranged by increasing time after transfection, from top to bottom. The grayscale represents log10 expression ratio (treated/mock) −0.6 (white) to +0.6 (black). From the results shown in FIG. 3, it was determined that transcripts enriched for miR-15a/miR-16 3' UTR seed region hexamer matches were downregulated as early as 6 hours following transfection (E>1E-2) in comparison to a control luciferase transfected control (E=5.5E-26). Transcripts in the intersection signature that were regulated (p<0.05) at 6 hours in HCT116Dicer$^{ex5}$ cells were defined as miR-16 consensus downregulated transcripts (N=116).

A second group of transcripts that were initially identified as downregulated in miR-15a/miR-16 transfected cells and annotated as "mitotic cell cycle" related transcripts were downregulated at 24 hours (E>1E-2) in comparison to a luciferase control at 24 hours (E=1.1E-80). This second group of transcripts that is downregulated more slowly (in contrast to the transcripts downregulated after 6 hours) appears to be indirectly affected by miR-16 modulation.

Analysis of miR-16 Family Consensus Transcripts (Downregulated after 6 Hours)

The individual transcripts downregulated after 6 hours (referred to as miR-16 family consensus transcripts), were tested for enrichment for annotation of the GO Biological Process term "cell cycle" and the miR-16 family seed region hexamer beginning at position 2. Of the N=116 transcripts that fell into the category of miR-16 consensus family transcripts, N=84 transcripts were selected for further analysis based on having a sequence record denoting ≥20 nucleotides of both CDS and 3' UTR. The background set for miR-16 transcriptional target comparisons comprised a set of transcripts that were not found to be down-regulated by miR-16, but having a similar distribution of expression levels and CDS and 3' UTR lengths (N=1,546).

Results:

The 84 miR-16 consensus transcripts were compared to the expression level-matched set (1546) to identify the presence of hexamer miR-16 seed target sites (positions 1-6, 2-7, or 3-8 of SEQ ID NO:3). Hexamer motifs matching the miR-16 seed target site were found in both coding sequence (CDS) and 3' UTR regions. The number of transcripts identified with CDS target sites was not found to differ significantly between the miR-16 down-regulated transcripts and the background set (data not shown). However, it was observed that 95% of the miR-16 6 hr downregulated transcripts contained miR-16 seed target sites in their 3' UTR, in comparison to 45% of controls (P<5E-13).

It was further determined that the miR-16 downregulated transcripts contain multiple copies of miR-16 target sites in their 3' UTRs. The median number of miR-16 target sites in the 3' UTR regions of miR-16 consensus transcripts was found to be 2, with the control group having less than 1% occurrence of more than 1 miR-16 target site. The significance the two groups was determined to have a Wilcoxon rank-sum P value<1E-10.

The increased number target sites per transcript for miR-16 down-regulated transcripts was partially attributable to longer 3' UTRs in these transcripts (median of ~1,150 nt for miR-16 down regulated transcripts, versus ~660 nt for the background set, P<1E-2), but more significantly to a greater number of target sites per kilobase of 3' UTR (2.3 per kb versus 0.2 in controls (P<4E-10)).

Furthermore, the longest target site per transcript was significantly longer for miR-16 down-regulated transcripts (P<5E-14). This was true even when transcripts without hexamer matches were excluded: the median length of the longest site per miR-16 target was 8 bases, vs. 6 bases for background transcripts with hexamer matches (P<3E-10). Thus, many miR-16 down-regulated transcripts have multiple target sites matching the miR-16 seed region, generally with at least one site showing extended complementarity to the miR-16 seed.

It was observed that the 3' UTRs of miR-16 downregulated transcripts were longer (median of 1200 nt) than the 3' UTR regions from background transcripts, with a median value of 600 nt. The significance of the difference between the groups was determined to have a Wilcoxon rank-sum P value<4E-3.

Finally, it was observed that the 3' UTRs of miR-16 downregulated transcripts had a higher density of miR-16 target sites in their 3' UTR (about 2% of the 3' UTR) in comparison to background transcripts (about 0.5% of the 3' UTR). The significance of the difference between the groups was determined to have a Wilcoxon rank-sum P value <1E-12.

Therefore, these results confirm that both mitotic cell cycle genes and putative targets of miR-15a and miR-16 were enriched in 24 hour down-regulated signatures. Further, these results suggest that miR-15a and miR-16 directly targets cell cycle genes at the G0/G1 phase of the cell cycle and indirectly effects cell cycle regulation during the S and G2/M phase. Therefore, mitotic cell cycle genes in miR-15a and miR-16 downregulated signatures is likely to be a downstream indirect effect of regulation of direct targets of miR-15a and miR-16.

TABLE 5 miR-16 Consensus Downregulated Targets: [N = 116]

| Transcript/ Transcript ID, Genbank Accessed May 20, 2006 | Gene/Gene Symbol | Gene/ Unigene | Transcript/ Description (SEQ ID NO:) |
|---|---|---|---|
| AB002445 | DCP2 | Hs.282984; Hs.443875; Hs.559758 | length = 1935 *Homo sapiens* mRNA from chromosome 5q21-22, clone: FBR35. (SEQ ID NO: 428) |
| AB018268 | DDHD2 | Hs.434966 | length = 3911 *Homo sapiens* mRNA for KIAA0725 protein, partial cds. (SEQ ID NO: 429) |
| AF085867 | | | length = 500 *Homo sapiens* full length insert cDNA clone YN88C07. (SEQ ID NO: 430) |
| AF131831 | CDC42SE2 | Hs.508829 | length = 2067 *Homo sapiens* clone 25186 mRNA sequence. (SEQ ID NO: 431) |
| AF174600 | LMO7 | Hs.207631 | length = 765 *Homo sapiens* F-box protein Fbx20 (FBX20) mRNA, partial cds. (SEQ ID NO: 432) |
| AK000660 | CDK6 | Hs.119882 | length = 1198 *Homo sapiens* cDNA FLJ20653 fis, clone KAT01739. (SEQ ID NO: 433) CDK6 cDNA (SEQ ID NO: 366) encoding CDK6 protein (SEQ ID NO: 367) |
| AK022628 | | | length = 2402 *Homo sapiens* cDNA FLJ12566 fis, clone NT2RM4000852. (SEQ ID NO: 434) |
| AK074041 | DNAJC5 | Hs.164419 | length = 4870 *Homo sapiens* mRNA for FLJ00095 protein. (SEQ ID NO: 435) |
| AL117477 | PHF19 | Hs.460124 | length = 3682 *Homo sapiens* mRNA; cDNA DKFZp727G051 (from clone DKFZp727G051); partial cds. (SEQ ID NO: 436) |
| AL390158 | ATXN7L3 | Hs.512651 | length = 3030 *Homo sapiens* mRNA; cDNA DKFZp761G2113 (from clone DKFZp761G2113). (SEQ ID NO: 437) |
| Contig18476_RC | | | Sim: BC040307, *Homo sapiens* cDNA clone IMAGE: 4830091, partial cds. (e = 0.0, score = 872,99% ID over 444nt [query = 445nt], plus strand, blastn) |
| Contig28760_RC | CDK6 | Hs.119882 | cyclin-dependent kinase 6 CDK6 cDNA (SEQ ID NO: 366) encoding CDK6 protein (SEQ ID NO: 367) |
| Contig28947_RC | CDC25A | Hs.1634 | cell division cycle 25A |
| Contig35088_RC | CDC37L1 | Hs.493361 | cell division cycle 37 homolog (*S. cerevisiae*)-like 1 |
| Contig41954_RC | | | Sim: CB434576, Transcribed locus (e = 1e-57, score = 132,64% ID over 91aa [query = 585nt], -3/-3 frame, tblastx) |
| Contig44068_RC | E2F7 | Hs.416375 | E2F transcription factor 7 |
| Contig46176_RC | FBXW7 | Hs.519029 | F-box and WD-40 domain protein 7 (archipelago homolog, *Drosophila*) |
| Contig47267_RC | KLHL15 | Hs.495854 | kelch-like 15 (*Drosophila*) |
| Contig48436_RC | KIAA1698 | Hs.458390 | Sim: BC060841, KIAA1698 protein (e = 0.0, score = 1786, 99% ID over 917nt [query = 915nt], plus strand, blastn) |
| Contig48722_RC | | Hs.126857 | Sim: BC044234, *Homo sapiens*, clone IMAGE: 5729395, mRNA. (e = 0.0, score = 1233, 100% ID over 622nt [query = 625nt], plus strand, blastn) |

TABLE 5-continued miR-16 Consensus Downregulated Targets: [N = 116]

| Transcript/ Transcript ID, Genbank Accessed May 20, 2006 | Gene/Gene Symbol | Gene/ Unigene | Transcript/ Description (SEQ ID NO:) |
|---|---|---|---|
| Contig49175_RC | | Hs.349096 | Sim: AK095023, *Homo sapiens* cDNA FLJ37704 fis, clone BRHIP2017385. (e = 0.0, score = 1792, 99% ID over 920nt [query = 919nt], plus strand, blastn) |
| Contig49578_RC | THUMPD1 | Hs.460232 | THUMP domain containing 1 |
| Contig50106_RC | KIF21A | Hs.374201 | kinesin family member 21A |
| Contig50584_RC | | | Sim: AJ420516, *Homo sapiens* mRNA full length insert cDNA clone EUROIMAGE 966164. (e = 0.0, score = 981, 100% ID over 495nt [query = 495nt], plus strand, blastn) |
| Contig51140_RC | SLC39A5 | Hs.556043 | solute carrier family 39 (metal ion transporter), member 5 |
| Contig52789_RC | | | Sim: AK025305, *Homo sapiens* cDNA: FLJ21652 fis, clone COL08582. (e = 0.0, score = 1651, 100% ID over 833nt [query = 835nt], plus strand, blastn) |
| Contig55991_RC | PURA | Hs.443121 | purine-rich element binding protein A |
| D86982 | ANKS1A | Hs.132639 | length = 6335 Human mRNA for KIAA0229 gene, partial cds. (SEQ ID NO: 438) |
| NM_000286 | PEX12 | Hs.270532 | *Homo sapiens* peroxisomal biogenesis factor 12 (PEX12), mRNA. (SEQ ID NO: 439) |
| NM_000401 | EXT2 | Hs.368404 | *Homo sapiens* exostoses (multiple) 2 (EXT2), transcript variant 1, mRNA. (SEQ ID NO: 440) |
| NM_000617 | SLC11A2 | Hs.505545 | *Homo sapiens* solute carrier family 11 (proton-coupled divalent metal ion transporters), member 2 (SLC11A2), mRNA. (SEQ ID NO: 441) |
| NM_001197 | BIK | Hs.475055 | *Homo sapiens* BCL2-interacting killer (apoptosis-inducing) (BIK), mRNA. (SEQ ID NO: 442) |
| NM_001238 | CCNE1 | Hs.244723 | *Homo sapiens* cyclin E1 (CCNE1), transcript variant 1, mRNA. (SEQ ID NO: 443) |
| NM_001256 | CDC27 | Hs.463295 | *Homo sapiens* cell division cycle 27 (CDC27), mRNA. (SEQ ID NO: 444) CDC27 cDNA (SEQ ID NO: 368) encoding CDC27 protein (SEQ ID NO: 369) |
| NM_001274 | CHEK1 | Hs.24529 | *Homo sapiens* CHK1 checkpoint homolog (*S. pombe*) (CHEK1), mRNA. (SEQ ID NO: 445) |
| NM_001303 | COX10 | Hs.462278 | *Homo sapiens* COX10 homolog, cytochrome c oxidase assembly protein, heme A: farnesyltransferase (yeast) (COX10), nuclear gene encoding mitochondrial protein, mRNA. (SEQ ID NO: 446) |
| NM_002056 | GFPT1 | Hs.468864 | *Homo sapiens* glutamine-fructose-6-phosphate transaminase 1 (GFPT1), mRNA. (SEQ ID NO: 447) |
| NM_002105 | H2AFX | Hs.477879 | *Homo sapiens* H2A histone family, member X (H2AFX), mRNA. (SEQ ID NO: 448) |
| NM_003047 | SLC9A1 | Hs.469116 | *Homo sapiens* solute carrier family 9 (sodium/hydrogen exchanger), isoform 1 (antiporter, Na+/H+, amiloride sensitive) (SLC9A1), mRNA. (SEQ ID NO: 449) |
| NM_003139 | SRPR | Hs.368376 | *Homo sapiens* signal recognition particle receptor ('docking protein') (SRPR), mRNA. (SEQ ID NO: 450) |
| NM_003390 | WEE1 | Hs.249441 | *Homo sapiens* WEE1 homolog (*S. pombe*) (WEE1), mRNA. (SEQ ID NO: 451) |
| NM_003818 | CDS2 | Hs.472027 | *Homo sapiens* CDP-diacylglycerol synthase (phosphatidate |

TABLE 5-continued miR-16 Consensus Downregulated Targets: [N = 116]

| Transcript/ Transcript ID, Genbank Accessed May 20, 2006 | Gene/Gene Symbol | Gene/ Unigene | Transcript/ Description (SEQ ID NO:) |
|---|---|---|---|
| | | | cytidylyltransferase) 2 (CDS2), mRNA. (SEQ ID NO: 452) |
| NM_004178 | TARBP2 | Hs.326 | Homo sapiens TAR (HIV) RNA binding protein 2 (TARBP2), transcript variant 3, mRNA. (SEQ ID NO: 453) |
| NM_004309 | ARHGDIA | Hs.159161 | Homo sapiens Rho GDP dissociation inhibitor (GDI) alpha (ARHGDIA), mRNA. (SEQ ID NO: 454) |
| NM_004327 | BCR | Hs.517461; Hs.534451 | Homo sapiens breakpoint cluster region (BCR), transcript variant 1, mRNA. (SEQ ID NO: 455) |
| NM_004586 | RPS6KA3 | Hs.445387 | Homo sapiens ribosomal protein S6 kinase, 90 kDa, polypeptide 3 (RPS6KA3), mRNA. (SEQ ID NO: 456) |
| NM_004798 | KIF3B | Hs.369670 | Homo sapiens kinesin family member 3B (KIF3B), mRNA. (SEQ ID NO: 457) |
| NM_004890 | SPAG7 | Hs.90436 | Homo sapiens sperm associated antigen 7 (SPAG7), mRNA. (SEQ ID NO: 458) |
| NM_005133 | RCE1 | Hs.553511 | Homo sapiens RCE1 homolog, prenyl protein protease (S. cerevisiae) (RCE1), mRNA. (SEQ ID NO: 459) |
| NM_005346 | HSPA1B | Hs.274402 | Homo sapiens heat shock 70 kDa protein 1B (HSPA1B), mRNA. (SEQ ID NO: 460) |
| NM_005389 | PCMT1 | Hs.279257 | Homo sapiens protein-L-isoaspartate (D-aspartate) O-methyltransferase (PCMT1), mRNA. (SEQ ID NO: 461) |
| NM_006283 | TACC1 | Hs.279245 | Homo sapiens transforming, acidic coiled-coil containing protein 1 (TACC1), mRNA. (SEQ ID NO: 462) |
| NM_006313 | USP15 | Hs.434951 | Homo sapiens ubiquitin specific protease 15 (USP15), mRNA. (SEQ ID NO: 463) |
| NM_006589 | C1orf2 | Hs.348308 | Homo sapiens chromosome 1 open reading frame 2 (C1orf2), transcript variant 1, mRNA. (SEQ ID NO: 464) |
| NM_006612 | KIF1C | Hs.435120 | Homo sapiens kinesin family member 1C (KIF1C), mRNA. (SEQ ID NO: 465) |
| NM_007013 | WWP1 | Hs.533440 | Homo sapiens WW domain containing E3 ubiquitin protein ligase 1 (WWP1), mRNA. (SEQ ID NO: 466) |
| NM_007260 | LYPLA2 | Hs.533479 | Homo sapiens lysophospholipase II (LYPLA2), mRNA. (SEQ ID NO: 467) |
| NM_012290 | TLK1 | Hs.470586 | Homo sapiens tousled-like kinase 1 (TLK1), mRNA. (SEQ ID NO: 468) |
| NM_012337 | CCDC19 | Hs.158450 | Homo sapiens coiled-coil domain containing 19 (CCDC19), mRNA. (SEQ ID NO: 469) |
| NM_014062 | PSMD8BP1 | Hs.271695 | Homo sapiens nin one binding protein (NOB1P), mRNA. (SEQ ID NO: 470) |
| NM_014292 | CBX6 | Hs.511952 | Homo sapiens chromobox homolog 6 (CBX6), mRNA. (SEQ ID NO: 471) |
| NM_014550 | CARD10 | Hs.57973 | Homo sapiens caspase recruitment domain family, member 10 (CARD10), mRNA. (SEQ ID NO: 472) CARD10 cDNA (SEQ ID NO: 370) encoding CARD10 protein (SEQ ID NO: 371) |

TABLE 5-continued miR-16 Consensus Downregulated Targets: [N = 116]

| Transcript/ Transcript ID, Genbank Accessed May 20, 2006 | Gene/Gene Symbol | Gene/ Unigene | Transcript/ Description (SEQ ID NO:) |
|---|---|---|---|
| NM_014821 | KIAA0317 | Hs.497417 | Homo sapiens KIAA0317 (KIAA0317), mRNA. (SEQ ID NO: 473) |
| NM_014874 | MFN2 | Hs.376681 | Homo sapiens mitofusin 2 (MFN2), nuclear gene encoding mitochondrial protein, mRNA. (SEQ ID NO: 474) |
| NM_014904 | RAB11FIP2 | Hs.173656 | Homo sapiens RAB11 family interacting protein 2 (class I) (RAB11FIP2), mRNA. (SEQ ID NO: 475) |
| NM_015282 | CLASP1 | Hs.469840 | Homo sapiens cytoplasmic linker associated protein 1 (CLASP1), mRNA. (SEQ ID NO: 476) |
| NM_015391 | ANAPC13 | Hs.106909 | Homo sapiens anaphase promoting complex subunit 13 (ANAPC13), mRNA. (SEQ ID NO: 477) |
| NM_015938 | NMD3 | Hs.492805 | Homo sapiens NMD3 homolog (S. cerevisiae) (NMD3), mRNA. (SEQ ID NO: 478) |
| NM_016172 | UBADC1 | Hs.9194 | Homo sapiens ubiquitin associated domain containing 1 (UBADC1), mRNA. (SEQ ID NO: 479) |
| NM_016271 | RNF138 | Hs.302408; Hs.501040 | Homo sapiens ring finger protein 138 (RNF138), transcript variant 1, mRNA. (SEQ ID NO: 480) |
| NM_016453 | NCKIPSD | Hs.102929 | Homo sapiens NCK interacting protein with SH3 domain (NCKIPSD), transcript variant 1, mRNA. (SEQ ID NO: 481) |
| NM_016506 | KBTBD4 | Hs.440695 | Homo sapiens kelch repeat and BTB (POZ) domain containing 4 (KBTBD4), transcript variant 2, mRNA. (SEQ ID NO: 482) |
| NM_017582 | UBE2Q1 | Hs.516587 | Homo sapiens ubiquitin-conjugating enzyme E2Q (putative) (UBE2Q), mRNA. (SEQ ID NO: 483) |
| NM_017742 | ZCCHC2 | Hs.114191 | Homo sapiens zinc finger, CCHC domain containing 2 (ZCCHC2), mRNA. (SEQ ID NO: 484) |
| NM_017811 | UBE2R2 | Hs.11184 | Homo sapiens ubiquitin-conjugating enzyme E2R 2 (UBE2R2), mRNA. (SEQ ID NO: 485) |
| NM_017913 | CDC37L1 | Hs.493361 | Homo sapiens cell division cycle 37 homolog (S. cerevisiae)-like 1 (CDC37L1), mRNA. (SEQ ID NO: 486) |
| NM_017955 | CDCA4 | Hs.34045 | Homo sapiens cell division cycle associated 4 (CDCA4), transcript variant 1, mRNA. (SEQ ID NO: 487) |
| NM_018316 | KLHL26 | Hs.250632 | Homo sapiens hypothetical protein FLJ11078 (FLJ11078), mRNA. (SEQ ID NO: 488) |
| NM_018339 | RFK | Hs.37558 | Homo sapiens riboflavin kinase (RFK), mRNA. (SEQ ID NO: 489) |
| NM_018347 | C20orf29 | Hs.104806 | Homo sapiens chromosome 20 open reading frame 29 (C20orf29), mRNA. (SEQ ID NO: 490) |
| NM_018668 | VPS33B | Hs.459366 | Homo sapiens vacuolar protein sorting 33B (yeast) (VPS33B), mRNA. (SEQ ID NO: 491) |
| NM_018685 | ANLN | Hs.62180 | Homo sapiens anillin, actin binding protein (scraps homolog, Drosophila) (ANLN), mRNA. (SEQ ID NO: 492) |
| NM_019008 | RP5-1104E15.5 | Hs.148677; Hs.580996 | Homo sapiens hypothetical protein FLJ20232 (FLJ20232), mRNA. (SEQ ID NO: 493) |
| NM_019048 | ASNSD1 | Hs.101364 | Homo sapiens HCV NS3-transactivated protein 1 (NS3TP1), mRNA. (SEQ ID NO: 494) |

TABLE 5-continued miR-16 Consensus Downregulated Targets: [N = 116]

| Transcript/ Transcript ID, Genbank Accessed May 20, 2006 | Gene/Gene Symbol | Gene/ Unigene | Transcript/ Description (SEQ ID NO:) |
| --- | --- | --- | --- |
| NM_021809 | TGIF2 | Hs.292281 | *Homo sapiens* TGFB-induced factor 2 (TALE family homeobox) (TGIF2), mRNA. (SEQ ID NO: 495) |
| NM_021959 | PPP1R11 | Hs.82887 | *Homo sapiens* protein phosphatase 1, regulatory (inhibitor) subunit 11 (PPP1R11), transcript variant 1, mRNA. (SEQ ID NO: 496) |
| NM_022442 | UBE2V1 | Hs.420529 | *Homo sapiens* ubiquitin-conjugating enzyme E2 variant 1 (UBE2V1), transcript variant 3, mRNA. (SEQ ID NO: 497) |
| NM_022739 | SMURF2 | Hs.515011 | *Homo sapiens* SMAD specific E3 ubiquitin protein ligase 2 (SMURF2), mRNA. (SEQ ID NO: 498) |
| NM_022755 | IPPK | Hs.16603; Hs.459896 | *Homo sapiens* chromosome 9 open reading frame 12 (C9orf12), mRNA. (SEQ ID NO: 499) |
| NM_024085 | ATG9A | Hs.323363 | *Homo sapiens* APG9 autophagy 9-like 1 (*S. cerevisiae*) (APG9L1), mRNA. (SEQ ID NO: 500) |
| NM_024092 | TMEM109 | Hs. 13662 | *Homo sapiens* hypothetical protein MGC5508 (MGC5508), mRNA. (SEQ ID NO: 501) |
| NM_024640 | YRDC | Hs.301564 | *Homo sapiens* ischemia/reperfusion inducible protein (YRDC), mRNA. (SEQ ID NO: 502) |
| NM_024698 | SLC25A22 | Hs.99486 | *Homo sapiens* solute carrier family 25 (mitochondrial carrier: glutamate), member 22 (SLC25A22), mRNA. (SEQ ID NO: 503) |
| NM_024900 | PHF17 | Hs.12420 | *Homo sapiens* PHD finger protein 17 (PHF17), transcript variant S, mRNA. (SEQ ID NO: 504) |
| NM_024954 | UBTD1 | Hs.500724 | *Homo sapiens* ubiquitin domain containing 1 (UBTD1), mRNA. (SEQ ID NO: 505) |
| NM_030884 | MAP4 | Hs.517949 | *Homo sapiens* microtubule-associated protein 4 (MAP4), transcript variant 2, mRNA. (SEQ ID NO: 506) |
| NM_032233 | SETD3 | Hs.510407 | *Homo sapiens* chromosome 14 open reading frame 154 (C14orf154), transcript variant 1, mRNA. (SEQ ID NO: 507) |
| NM_032245 | ELL | Hs.515260 | elongation factor RNA polymerase II. (SEQ ID NO: 508) |
| NM_032840 | SPRYD3 | Hs.343334 | *Homo sapiens* hypothetical protein FLJ14800 (FLJ14800), mRNA. (SEQ ID NO: 509) |
| NM_033044 | MACF1 | Hs.472475 | *Homo sapiens* microtubule-actin crosslinking factor 1 (MACF1), transcript variant 2, mRNA. (SEQ ID NO: 510) |
| NM_033632 | FBXW7 | Hs.519029 | *Homo sapiens* F-box and WD-40 domain protein 7 (archipelago homolog, *Drosophila*) (FBXW7), transcript variant 1, mRNA. (SEQ ID NO: 511) |
| NM_033637 | BTRC | Hs.500812 | *Homo sapiens* beta-transducin repeat containing (BTRC), transcript variant 1, mRNA. (SEQ ID NO: 512) |
| NM_080670 | SLC35A4 | Hs.406840 | *Homo sapiens* solute carrier family 35, member A4 (SLC35A4), mRNA. (SEQ ID NO: 513) |
| NM_138333 | C9orf42 | Hs.310425 | *Homo sapiens* chromosome 9 open reading frame 42 (C9orf42), mRNA. (SEQ ID NO: 514) |
| NM_138639 | BCL2L12 | Hs.289052 | *Homo sapiens* BCL2-like 12 (proline rich) (BCL2L12), transcript variant 1, mRNA. (SEQ ID NO: 515) |

TABLE 5-continued miR-16 Consensus Downregulated Targets: [N = 116]

| Transcript/ Transcript ID, Genbank Accessed May 20, 2006 | Gene/Gene Symbol | Gene/ Unigene | Transcript/ Description (SEQ ID NO:) |
|---|---|---|---|
| NM_138717 | PPT2 | Hs.332138 | *Homo sapiens* palmitoyl-protein thioesterase 2 (PPT2), transcript variant 2, mRNA. (SEQ ID NO: 516) |
| NM_144568 | TMEM55B | Hs.7001 | *Homo sapiens* transmembrane protein 55B (TMEM55B), mRNA. (SEQ ID NO: 517) |
| NM_145047 | C1orf102 | Hs.202207 | *Homo sapiens* chromosome 1 open reading frame 102 (C1orf102), transcript variant 1, mRNA. (SEQ ID NO: 518) |
| NM_145648 | SLC15A4 | Hs.507260 | *Homo sapiens* solute carrier family 15, member 4 (SLC15A4), mRNA. (SEQ ID NO: 519) |
| NM_153045 | C9orf91 | Hs.522357 | *Homo sapiens* chromosome 9 open reading frame 91 (C9orf91), mRNA. (SEQ ID NO: 520) |
| NM_153611 | CYBASC3 | Hs.22546 | *Homo sapiens* cytochrome b, ascorbate dependent 3 (CYBASC3), mRNA. (SEQ ID NO: 521) |
| NM_153810 | C10orf46 | Hs.420024 | *Homo sapiens* chromosome 10 open reading frame 46 (C10orf46), mRNA. (SEQ ID NO: 522) C10orf46 cDNA (SEQ ID NO: 372) encoding C10orf46 protein (SEQ ID NO: 373) |
| NM_170722 | NOD9 | Hs.524082 | *Homo sapiens* NOD9 protein (NOD9), transcript variant 2, mRNA. (SEQ ID NO: 523) |
| NM_175866 | UHMK1 | Hs.127310 | *Homo sapiens* U2AF homology motif (UHM) kinase 1 (UHMK1), mRNA. (SEQ ID NO: 524) |
| NM_182752 | FAM79A | Hs.20529 | *Homo sapiens* family with sequence similarity 79, member A (FAM79A), mRNA. (SEQ ID NO: 525) |
| X66087 | MYBL1 | Hs.445898 | length = 3587 *H. sapiens* a-myb mRNA. (SEQ ID NO: 526) |

TABLE 6 miR-16 Consensus Downregulated Targets [N = 65]

| Transcript/ Transcript ID, Genbank Accessed May 20, 2006 | Gene/Gene Symbol | Gene/ Unigene | Transcript/ Description |
|---|---|---|---|
| AB002445 | DCP2 | Hs.282984; Hs.443875; Hs.559758 | length = 1935 *Homo sapiens* mRNA from chromosome 5q21-22, clone: FBR35. |
| AB018268 | DDHD2 | Hs.434966 | length = 3911 *Homo sapiens* mRNA for KIAA0725 protein, partial cds. |
| AF085867 | | | length = 500 *Homo sapiens* full length insert cDNA clone YN88C07. |
| AF131831 | CDC42SE2 | Hs.508829 | length = 2067 *Homo sapiens* clone 25186 mRNA sequence. |
| AF174600 | LMO7 | Hs.207631 | length = 765 *Homo sapiens* F-box protein Fbx20 (FBX20) mRNA, partial cds. |
| AK022628 | | | length = 2402 *Homo sapiens* cDNA FLJ12566 fis, clone NT2RM4000852. |
| AK074041 | DNAJC5 | Hs.164419 | length = 4870 *Homo sapiens* mRNA for FLJ00095 protein. |
| AL390158 | ATXN7L3 | Hs.512651 | length = 3030 *Homo sapiens* mRNA; cDNA DKFZp761G2113 (from clone DKFZp761G2113). |
| Contig18476_RC | | | Sim: BC040307, *Homo sapiens* cDNA clone IMAGE: 4830091, partial cds. (e = 0.0, score = 872.99% ID over 444nt [query = 445nt], plus strand, blastn) |

TABLE 6-continued miR-16 Consensus Downregulated Targets [N = 65]

| Transcript/ Transcript ID, Genbank Accessed May 20, 2006 | Gene/Gene Symbol | Gene/ Unigene | Transcript/ Description |
|---|---|---|---|
| Contig41954_RC | | | Sim: CB434576, Transcribed locus (e = 1e−57, score = 132.64% ID over 91aa [query = 585nt], −3/−3 frame, tblastx) |
| Contig47267_RC | KLHL15 | Hs.495854 | kelch-like 15 (*Drosophila*) |
| Contig48436_RC | KIAA1698 | Hs.458390 | Sim: BC060841, KIAA1698 protein (e = 0.0, score = 1786.99% ID over 917nt [query = 915nt], plus strand, blastn) |
| Contig48722_RC | | Hs.126857 | Sim: BC044234, *Homo sapiens*, clone IMAGE: 5729395, mRNA. (e = 0.0, score = 1233.100% ID over 622nt [query = 625nt], plus strand, blastn) |
| Contig49175_RC | | Hs.349096 | Sim: AK095023, *Homo sapiens* cDNA FLJ37704 fis, clone BRHIP2017385. (e = 0.0, score = 1792.99% ID over 920nt [query = 919nt], plus strand, blastn) |
| Contig49578_RC | THUMPD1 | Hs.460232 | THUMP domain containing 1 |
| Contig50584_RC | | | Sim: AJ420516, *Homo sapiens* mRNA full length insert cDNA clone EUROIMAGE 966164. (e = 0.0, score = 981.100% ID over 495nt [query = 495nt], plus strand, blastn) |
| Contig52789_RC | | | Sim: AK025305, *Homo sapiens* cDNA: FLJ21652 fis, clone COL08582. (e = 0.0, score = 1651.100% ID over 833nt [query = 835nt], plus strand, blastn) |
| Contig55991_RC | PURA | Hs.443121 | purine-rich element binding protein A |
| NM_000286 | PEX12 | Hs.270532 | *Homo sapiens* peroxisomal biogenesis factor 12 (PEX12), mRNA |
| NM_000401 | EXT2 | Hs.368404 | *Homo sapiens* exostoses (multiple) 2 (EXT2), transcript variant 1, mRNA |
| NM_000617 | SLC11A2 | Hs.505545 | *Homo sapiens* solute carrier family 11 (proton-coupled divalent metal ion transporters), member 2 (SLC11A2), mRNA |
| NM_001197 | BIK | Hs.475055 | *Homo sapiens* BCL2-interacting killer (apoptosis-inducing) (BIK), mRNA |
| NM_001303 | COX10 | Hs.462278 | *Homo sapiens* COX10 homolog, cytochrome c oxidase assembly protein, heme A: farnesyltransferase (yeast) (COX10), nuclear gene encoding mitochondrial protein, mRNA |
| NM_002056 | GFPT1 | Hs.468864 | *Homo sapiens* glutamine-fructose-6-phosphate transaminase 1 (GFPT1), mRNA |
| NM_002105 | H2AFX | Hs.477879 | *Homo sapiens* H2A histone family, member X (H2AFX), mRNA |
| NM_003047 | SLC9A1 | Hs.469116 | *Homo sapiens* solute carrier family 9 (sodium/hydrogen exchanger), isoform 1 (antiporter, Na+/H+, amiloride sensitive) (SLC9A1), mRNA |
| NM_003139 | SRPR | Hs.368376 | *Homo sapiens* signal recognition particle receptor ('docking protein') (SRPR), mRNA |
| NM_004178 | TARBP2 | Hs.326 | *Homo sapiens* TAR (HIV) RNA binding protein 2 (TARBP2), transcript variant 3, mRNA |
| NM_004798 | KIF3B | Hs.369670 | *Homo sapiens* kinesin family member 3B (KIF3B), mRNA |
| NM_004890 | SPAG7 | Hs.90436 | *Homo sapiens* sperm associated antigen 7 (SPAG7), mRNA |
| NM_005133 | RCE1 | Hs.553511 | *Homo sapiens* RCE1 homolog, prenyl protein protease (*S. cerevisiae*) (RCE1), mRNA |
| NM_005346 | HSPA1B | Hs.274402 | *Homo sapiens* heat shock 70 kDa protein 1B (HSPA1B), mRNA |
| NM_006589 | C1orf2 | Hs.348308 | *Homo sapiens* chromosome 1 open reading frame 2 (C1orf2), transcript variant 1, mRNA |
| NM_012337 | CCDC19 | Hs.158450 | *Homo sapiens* coiled-coil domain containing 19 (CCDC19), mRNA |
| NM_014062 | PSMD8BP1 | Hs.271695 | *Homo sapiens* nin one binding protein (NOB1P), mRNA |
| NM_014292 | CBX6 | Hs.511952 | *Homo sapiens* chromobox homolog 6 (CBX6), mRNA |

TABLE 6-continued miR-16 Consensus Downregulated Targets [N = 65]

| Transcript/ Transcript ID, Genbank Accessed May 20, 2006 | Gene/Gene Symbol | Gene/ Unigene | Transcript/ Description |
|---|---|---|---|
| NM_014821 | KIAA0317 | Hs.497417 | Homo sapiens KIAA0317 (KIAA0317), mRNA |
| NM_014874 | MFN2 | Hs.376681 | Homo sapiens mitofusin 2 (MFN2), nuclear gene encoding mitochondrial protein, mRNA |
| NM_015282 | CLASP1 | Hs.469840 | Homo sapiens cytoplasmic linker associated protein 1 (CLASP1), mRNA |
| NM_015391 | ANAPC13 | Hs.106909 | Homo sapiens anaphase promoting complex subunit 13 (ANAPC13), mRNA |
| NM_015938 | NMD3 | Hs.492805 | Homo sapiens NMD3 homolog (S. cerevisiae) (NMD3), mRNA |
| NM_016172 | UBADC1 | Hs.9194 | Homo sapiens ubiquitin associated domain containing 1 (UBADC1), mRNA |
| NM_016453 | NCKIPSD | Hs.102929 | Homo sapiens NCK interacting protein with SH3 domain (NCKIPSD), transcript variant 1, mRNA |
| NM_018339 | RFK | Hs.37558 | Homo sapiens riboflavin kinase (RFK), mRNA |
| NM_018347 | C20orf29 | Hs.104806 | Homo sapiens chromosome 20 open reading frame 29 (C20orf29), mRNA |
| NM_018668 | VPS33B | Hs.459366 | Homo sapiens vacuolar protein sorting 33B (yeast) (VPS33B), mRNA |
| NM_019008 | RP5-1104E15.5 | Hs.148677; Hs.580996 | Homo sapiens hypothetical protein FLJ20232 (FLJ20232), mRNA |
| NM_019048 | ASNSD1 | Hs.101364 | Homo sapiens HCV NS3-transactivated protein 1 (NS3TP1), mRNA |
| NM_022755 | IPPK | Hs.16603; Hs.459896 | Homo sapiens chromosome 9 open reading frame 12 (C9orf12), mRNA |
| NM_024085 | ATG9A | Hs.323363 | Homo sapiens APG9 autophagy 9-like 1 (S. cerevisiae) (APG9L1), mRNA |
| NM_024092 | TMEM109 | Hs.13662 | Homo sapiens hypothetical protein MGC5508 (MGC5508), mRNA |
| NM_024640 | YRDC | Hs.301564 | Homo sapiens ischemia/reperfusion inducible protein (YRDC), mRNA |
| NM_024698 | SLC25A22 | Hs.99486 | Homo sapiens solute carrier family 25 (mitochondrial carrier: glutamate), member 22 (SLC25A22), mRNA |
| NM_024900 | PHF17 | Hs.12420 | Homo sapiens PHD finger protein 17 (PHF17), transcript variant S, mRNA |
| NM_024954 | UBTD1 | Hs.500724 | Homo sapiens ubiquitin domain containing 1 (UBTD1), mRNA |
| NM_080670 | SLC35A4 | Hs.406840 | Homo sapiens solute carrier family 35, member A4 (SLC35A4), mRNA |
| NM_138639 | BCL2L12 | Hs.289052 | Homo sapiens BCL2-like 12 (proline rich) (BCL2L12), transcript variant 1, mRNA |
| NM_144568 | TMEM55B | Hs.7001 | Homo sapiens transmembrane protein 55B (TMEM55B), mRNA |
| NM_145047 | C1orf102 | Hs.202207 | Homo sapiens chromosome 1 open reading frame 102 (C1orf102), transcript variant 1, mRNA |
| NM_145648 | SLC15A4 | Hs.507260 | Homo sapiens solute carrier family 15, member 4 (SLC15A4), mRNA |
| NM_153045 | C9orf91 | Hs.522357 | Homo sapiens chromosome 9 open reading frame 91 (C9orf91), mRNA |
| NM_153611 | CYBASC3 | Hs.22546 | Homo sapiens cytochrome b, ascorbate dependent 3 (CYBASC3), mRNA |
| NM_170722 | NOD9 | Hs.524082 | Homo sapiens NOD9 protein (NOD9), transcript variant 2, mRNA |
| NM_175866 | UHMK1 | Hs.127310 | Homo sapiens U2AF homology motif (UHM) kinase 1 (UHMK1), mRNA |
| NM_182752 | FAM79A | Hs.20529 | Homo sapiens family with sequence similarity 79, member A (FAM79A), mRNA |

Results: The set of miR-16 consensus downregulated transcripts (N=116) shown in TABLE 5 overlapped with, but were not identical to, computationally predicted miR-16 targets, as shown in FIG. 4. The set of 65 newly identified miR-16 responsive genes identified using the methods described herein are shown in TABLE 6. The cDNA sequences of the genes shown in TABLE 5 and TABLE 6 are provided by the corresponding GenBank Accession Numbers, which are all hereby incorporated by reference.

As shown in FIG. 4, and TABLE 6, nearly 60% (65/110) miR-16 downregulated transcripts were not predicted by either of two different computational methods (Krek et al., Nat Genet 37:495-500 (2005); Lewis et al., Cell 120:15-20 (2005)). Conversely, greater than 90% of the computationally derived miR-16 predicted targets were not significantly down-regulated on microarrays. Moreover, most computational targets were unique to the particular computational method used, e.g., 55% unique miR-16 targets were predicted using TargetScan; and 68% unique miR-16 targets were predicted using PicTar. Similar disparate results were found with miR-16 target prediction using other computational methods (John et al., *PloS Biol* 2:e363 (2004); Xie, X. et al., *Nature* 434:338-345 (2005) (data not shown)). The poor overlap was unlikely due to lack of target expression in HCT116 Dicer$^{ex5}$ cells, since this analysis was restricted to transcripts expressed at ≥1 copy per cell. Thus, the miR-16 consensus downregulated transcripts identified using the methods described and shown in TABLE 5 are largely distinct from computationally predicted miR-16 targets. As described in more detail in EXAMPLES 3-7, a high percentage of miR-16 consensus targets (18/25) whose disruption by siRNA triggered G0/G1 accumulation were identified using the methods of the invention were not predicted by a computational method.

With regard to cell cycle distribution of various cell types transfected with miR-16, it was observed that miR-16 induced the G0/G1 accumulation phenotype in HCT116 wt, DLD-1wt, and A549 cells (data not shown). However, the G0/G1 phenotype was not observed in Hela cells. While not wishing to be bound by theory, it is possible that miR-16 did not induce a G0/G1 accumulation in Hela cells because this cell type is known to be deficient in G1 checkpoint control.

EXAMPLE 3

This Example demonstrates that the miR-15a and miR-16 induced transcript downregulation induces cellular phenotypes.

Methods: 170 miRNA duplexes were transfected into HCT116dicer$^{ex5}$ and DLD-1Dicer$^{ex5}$ cells using the methods described in EXAMPLE 1. Control transfections were done in parallel with luciferase siRNA-transfected cells and with siRNA targeting PLK1, an essential mitotic kinase (Liu, X., et al., *PNAS* 100(10):5789-94 (2003)). Cell viability was measured 96 hours post transfection.

TABLE 7

| miRNA Duplex | | | | |
|---|---|---|---|---|
| miRNA Duplex | miRNA Antisense Oligo Sequence | SEQ ID NO: | % Control Viability (DLD-1 Dicerex5) | % Control Viability (HCT116 Dicerex5) |
| miR-16 | CCAAUAUUUACGUGCUGCAAAU | 31 | 13.5 | 24.5 |
| miR-15a | CAAACCAUUAUGUGCUGCAAAU | 29 | 13.8 | 19.7 |
| miR-15b | UAAACCAUGAUGUGCUGCAAAU | 68 | 16.3 | 25.2 |
| miR-195 | CAAUAUUUCUGUGCUGCAAAU | 69 | 35.7 | 78.6 |
| miR-103 | AUAGCCCUGUACAAUGCUGGUAU | 17 | 49.2 | 49.4 |
| miR-107 | AUAGCCCUGUACAAUGCUGGUAU | 70 | 50.6 | 36.8 |
| miR-192 | CUGUCAAUUCAUAGGUCUGAU | 39 | 4.0 | 10.5 |
| miR-215 | CUGUCAAUUCAUAGGUCUUAU | 55 | 4.4 | 5.7 |
| miR-133a | AGCUGGUUGAAGGGGAUUAAAU | 21 | 4.7 | 17.0 |
| miR-200b | UCAUUACCAGGCAGUAUUAGUGAU | 49 | 10.7 | 39.2 |
| miR-155 | CCUAUCACGAUUAGCAUUAAAU | 27 | 13.9 | 53.9 |
| miR-19b | AGUUUUGCAUGGAUUUGCAGAAU | 45 | 22.2 | 26.7 |
| miR-17-5p | UACCUGCACUGUAAGCACUUAGAU | 35 | 28.9 | 49.3 |
| miR-145 | GGGAUUCCUGGGAAAACUGGUCAU | 25 | 33.4 | 56.9 |
| miR-194 | CACAUGGAGUUGCUGUUAGAAU | 41 | 34.2 | 24.1 |
| miR-221 | AACCCAGCAGACAAUGUAGGUAU | 57 | 40.6 | 43.7 |
| let-7c | CCAUACAACCUACUACUUUAAU | 71 | 43.4 | 72.4 |
| miR-25 | AGACCGAGACAAGUGCAAAGAU | 59 | 49.1 | 33.8 |
| miR-21 | AACAUCAGUCUGAUAAGCAAAU | 53 | 50.6 | 68.1 |
| miR-141 | AUCUUUACCAGACAGUGAUAU | 23 | 53.0 | 36.5 |
| miR-18 | UCUGCACUAGAUGCACUUUAAU | 37 | 61.9 | 62.7 |
| miR-17-3p | AAGUGCCUUCACUGCACUAU | 33 | 63.8 | 45.8 |
| miR-93 | ACCUGCACGAACAGCACUUUAU | 63 | 63.9 | 83.7 |

TABLE 7-continued

| miRNA Duplex | miRNA Antisense Oligo Sequence | SEQ ID NO: | % Control Viability (DLD-1 Dicerex5) | % Control Viability (HCT116 Dicerex5) |
|---|---|---|---|---|
| miR-200a | AUCGUUACCAGACAGUGUAAAU | 47 | 78.3 | 62.1 |
| miR-92 | AGGCCGGGACAAGUGCAAUAAU | 61 | 80.5 | 56.1 |
| miR-106b | CUGCACUGUCAGCACUUUAAU | 19 | 140.8 | 111.2 |
| miR-20 | CCUGCACUAUAAGCACUUUAAU | 72 | 147.0 | 147.9 |
| NM-005030 | | | 8.5 | 6.6 |
| NM-005030 | | | 12.4 | 11.2 |
| miR-326 | GGAGGAAGGGCCCAGACGAU | 73 | 1.5 | 3.6 |
| miR-193 | GGGACUUUGUAGGCCAGUUAU | 74 | 2.6 | 5.6 |
| miR-214 | GCCUGUCUGUGCCUGUUGUAU | 75 | 2.9 | 12.1 |
| miR-28 | CAAUAGACUGUGAGCUCCAUAU | 76 | 3.9 | 9.9 |
| miR-124a | GCAUUCACCGCGUGCCUUAAAU | 77 | 4.0 | 8.4 |
| miR-24 | GUUCCUGCUGAACUGAGCGAAU | 78 | 4.7 | 4.4 |
| miR-299 | GUAUGUGGGACGGUAAACGAAU | 79 | 4.8 | 16.7 |
| miR-346 | AGGCAGGCAUGCGGGCAGAUAAU | 80 | 5.4 | 14.0 |
| miR-199astar | CCAAUGUGCAGACUACUGAAAU | 81 | 5.5 | 13.6 |
| miR-210 | GCCGCUGUCACACGCAUAGAU | 82 | 6.1 | 15.0 |
| miR-134 | CUCUGGUCAACCAGUCAGAAU | 83 | 6.3 | 11.6 |
| miR-206 | ACACACUUCCUUACAUUUUAAU | 84 | 7.0 | 25.3 |
| miR-22 | AGUUCUUCAACUGGCAGCAUAU | 85 | 7.5 | 26.5 |
| miR-320 | CGCCCUCUCAACCCAGCUUUUAU | 86 | 8.2 | 24.2 |
| miR-216 | CAGUUGCCAGCUGAGAUAAAU | 87 | 8.8 | 29.4 |
| miR-337 | AGGCAUCAUAUAGGAGCUGCAAU | 88 | 9.4 | 25.9 |
| miR-125b | ACAAGUUAGGGUCUCAGGCAAU | 89 | 10.3 | 10.9 |
| miR-34c | AUCAGCUAACUACACUGCGUAU | 90 | 12.1 | 20.0 |
| miR-331 | CUAGGAUAGGCCCAGGGCCAU | 91 | 12.1 | 16.8 |
| miR-34b | AUCAGCUAAUGACACUGCGUAU | 92 | 12.2 | 14.1 |
| miR-371 | ACUCAAAAGAUGGCGGCUCAU | 93 | 12.9 | 22.0 |
| miR-137 | ACGCGUAUUCUUAAGCAAUAAU | 94 | 13.6 | 19.2 |
| miR-143 | AGCUACAGUGCUUCAUUUUAAU | 95 | 13.8 | 36.6 |
| miR-345 | CCUGGACUAGGAGUCAGGAAU | 96 | 14.0 | 22.7 |
| stoffel | ACGCGAGCCGAACGAACAAAAU | 97 | 14.3 | 54.8 |
| miR-196b | AACAACAGGAAACUACCAAAU | 98 | 15.7 | 31.3 |
| miR-147 | AGAAGCAUUUCCACACUCAU | 99 | 16.4 | 13.4 |
| miR-7 | CAAAAUCACUAGUCUUCGAAU | 100 | 17.0 | 25.1 |
| miR-183 | GUGAAUUCUACCAGUGCUAUAAU | 101 | 18.0 | 12.3 |
| miR-1 | CAUACUUCUUUACAUUCGAAU | 102 | 18.4 | 44.5 |
| miR-196a | AACAACAUGAAACUACCAAAU | 103 | 18.9 | 35.0 |

TABLE 7-continued miRNA Duplex

| miRNA Duplex | miRNA Antisense Oligo Sequence | SEQ ID NO: | % Control Viability (DLD-1 Dicerex5) | % Control Viability (HCT116 Dicerex5) |
|---|---|---|---|---|
| miR-189 | UGAUAUCAGCUCAGUAGGCUCAU | 104 | 19.0 | 22.7 |
| miR-34a | AACCAGCUAAGACACUGCGAAU | 105 | 19.5 | 14.7 |
| miR-197 | UGGGUGGAGAAGGUGGUGUAAU | 106 | 20.0 | 10.6 |
| miR-23b | GGUAAUCCCUGGCAAUGUGUUAU | 107 | 20.3 | 38.5 |
| miR-339 | AGCUCCUGGAGGACAGGCAAU | 108 | 20.5 | 31.3 |
| miR-148a | AAAGUUCUGUAGUGCACUCAAU | 109 | 21.2 | 44.5 |
| miR-140 | ACCAUAGGGUAAAACUAUUAU | 110 | 22.0 | 37.0 |
| miR-33 | AUGCAACUACAAUGCUCAU | 111 | 22.0 | 63.4 |
| let-7f | CUAUACAAUCUACUACCUGAAU | 112 | 22.3 | 33.9 |
| miR-149 | AGUGAAGACACGGAGCCACAAU | 113 | 22.7 | 26.5 |
| miR-148b | AAAGUUCUGUGAUGCACUCAAU | 114 | 22.7 | 84.0 |
| miR-205 | GACUCCGGUGGAAUGAAGCAAU | 115 | 22.8 | 15.5 |
| miR-330 | UCUGCAGGCCGUGUGCUUUCCAU | 116 | 23.0 | 30.0 |
| miR-325 | UUACUGGACACCUACUACGAU | 117 | 23.0 | 32.9 |
| miR-135b | CAUAGGAAUGAAAAGCCAAAAU | 118 | 23.0 | 47.4 |
| let-7a | CUAUACAACCUACUACCUGAAU | 119 | 23.2 | 47.3 |
| miR-208 | AAGCUUUUUGCUCGUCUUUUAU | 120 | 23.9 | 29.9 |
| miR-142-3p | CAUAAAGUAGGAAACACUAGAAU | 121 | 24.1 | 34.7 |
| miR-370 | AGGUUCCACCCCAGCAGCCAU | 122 | 24.3 | 68.1 |
| miR-217 | CCAAUCAGUUCCUGAUGCAGAAAU | 123 | 25.0 | 20.9 |
| miR-101 | UCAGUUAUCACAGUACUGAAAU | 124 | 25.7 | 15.5 |
| miR-122a | AAACACCAUUGUCACACUCGAAU | 125 | 26.2 | 12.8 |
| miR-135a | ACAUAGGAAUAAAAAGCCAAAAU | 126 | 28.2 | 49.0 |
| miR-328 | GGAAGGGCAGAGAGGGCCUGAU | 127 | 28.6 | 40.0 |
| miR-324-3p | AGCAGCACCUGGGGCAGUCGAU | 128 | 29.4 | 41.3 |
| miR-133b | GCUGGUUGAAGGGGAUUAAAU | 129 | 30.6 | 25.9 |
| miR-203 | AGUGGUCCUAAACAUUUCUCAU | 130 | 30.8 | 41.1 |
| miR-368 | ACGUGGAAUUCCUCUAUCUAU | 131 | 31.9 | 61.2 |
| let-7g | UGUACAAACUACUACCUGAAU | 132 | 32.5 | 44.9 |
| miR-153 | ACUUUUGUGACUAUGCUAAU | 133 | 33.8 | 32.9 |
| miR-96 | AAAAAUGUGCUAGUGCCAUAAU | 134 | 34.2 | 23.8 |
| miR-144 | AGUACAUCAUCUAUACUGAAAU | 135 | 34.8 | 39.5 |
| miR-127 | CCAAGCUCAGACGGAUCCCAAU | 136 | 35.5 | 61.0 |
| miR-190 | CUAAUAUAUCAAACAUAUGAAU | 137 | 36.6 | 55.3 |
| miR-95 | CUCAAUAAAUACCCGUUGUAAU | 138 | 37.5 | 37.0 |
| let-7b | CCACACAACCUACUACUUUAAU | 139 | 38.2 | 78.4 |

TABLE 7-continued miRNA Duplex

| miRNA Duplex | miRNA Antisense Oligo Sequence | SEQ ID NO: | % Control Viability (DLD-1 Dicerex5) | % Control Viability (HCT116 Dicerex5) |
|---|---|---|---|---|
| miR-126 | AUUAUUACUCACGGUACCAAU | 140 | 38.9 | 75.2 |
| miR-10a | CAAAUUCGGAUCUACAGGGAAAU | 141 | 39.4 | 31.6 |
| miR-29c | ACCGAUUUCAAAUGGUGUUAAU | 142 | 39.9 | 42.7 |
| miR-108 | UGCCCCUAAAAAUCCUUAUAU | 143 | 41.2 | 71.0 |
| let-7i | CACAAACUACUACCUGAAU | 144 | 42.7 | 75.0 |
| miR-105 | AGGAGUCUGAGCAUUUCAAU | 145 | 42.9 | 40.6 |
| miR-29a | CCGAUUUCAGAUGGUGUUAGAU | 146 | 43.8 | 31.7 |
| miR-27b | GAACUUAGCCACUGUGUAAU | 147 | 44.7 | 26.5 |
| miR-128b | AAGAGACCGGUUCACUGUCAAU | 148 | 44.7 | 63.9 |
| miR-9star | UUUCGGUUAUCUAGCUUAAAU | 149 | 45.3 | 38.0 |
| let-7e | UAUACAACCUCCUACCUGAAU | 150 | 48.1 | 48.7 |
| miR-23a | AAAUCCCUGGCAAUGUGUUAU | 151 | 49.3 | 73.3 |
| miR-191 | CUGCUUUUGGGAUUCCGUAGAU | 152 | 50.4 | 44.3 |
| let-7d | UAUGCAACCUACUACCUGUAU | 153 | 52.0 | 59.7 |
| miR-9 | AUACAGCUAGAUAACCAAACAAU | 154 | 52.2 | 42.2 |
| miR-213 | UACAAUCAACGGUCGAUGCUAU | 155 | 52.8 | 85.9 |
| miR-31 | GCUAUGCCAGCAUCUUGGCAU | 156 | 53.6 | 48.8 |
| miR-218 | AUGGUUAGAUCAAGCACUAAU | 157 | 56.7 | 36.8 |
| miR-98 | CAAUACAACUUACUACCUGAAU | 158 | 56.8 | 78.9 |
| miR-212 | CCGUGACUGGAGACUGUUAAU | 159 | 58.1 | 70.7 |
| miR-26b | CUAUCCUGAAUUACUUGUAAU | 160 | 58.6 | 56.2 |
| miR-211 | GCGAAGGAUGACAAAGGGUAAU | 161 | 60.0 | 68.7 |
| miR-100 | CAAGUUCGGAUCUACGGGAUAU | 162 | 61.8 | 103.5 |
| miR-26a | CCUAUCCUGGAUUACUUGUAAU | 163 | 63.4 | 86.1 |
| miR-19a | AGUUUUGCAUAGAUUUGCAGAAU | 164 | 64.1 | 75.0 |
| miR-302c | ACUGAAACAUGGAAGCAUUUAAU | 165 | 64.1 | 91.5 |
| miR-223 | GGUAUUUGACAAACUGAGAAU | 166 | 64.4 | 57.4 |
| miR-199a | ACAGGUAGUCUGAACACUGCGAU | 167 | 65.5 | 105.7 |
| miR-323 | AGGUCGACCGUGUAAAUGUCCAU | 168 | 65.7 | 82.5 |
| miR-220 | AGUGUCAGAUACGGUGUCGAU | 169 | 66.5 | 69.9 |
| miR-302a | ACCAAAACAUGGAAGCACUUAAU | 170 | 66.7 | 84.2 |
| miR-132 | ACCAUGGCUGUAGACUGUAAAU | 171 | 66.7 | 91.3 |
| miR-151 | UCAAGGAGCUUCAGUCUACUAU | 172 | 67.3 | 67.1 |
| miR-222 | GACCCAGUAGCCAGAUGUAGGUAU | 173 | 67.8 | 81.1 |
| miR-200c | CAUCAUUACCCGGCAGUAAUAU | 174 | 68.5 | 39.3 |
| miR-99b | CAAGGUCGGUUCUACGGGAGAU | 175 | 69.0 | 116.7 |
| miR-182star | GUUGGCAAGUCUAGAACGAAU | 176 | 69.4 | 130.0 |

TABLE 7-continued miRNA Duplex

| miRNA Duplex | miRNA Antisense Oligo Sequence | SEQ ID NO: | % Control Viability (DLD-1 Dicerex5) | % Control Viability (HCT116 Dicerex5) |
|---|---|---|---|---|
| miR-184 | CCUUAUCAGUUCUCCGUUUAAU | 177 | 71.6 | 116.8 |
| miR-10b | AAAUUCGGUUCUACAGGGAAAU | 178 | 73.6 | 47.5 |
| miR-106a | UACCUGCACUGUAAGCACUUUUAU | 179 | 73.9 | 93.8 |
| miR-32 | AACUUAGUAAUGUGCAAAAAU | 180 | 75.5 | 98.4 |
| miR-128a | AAGAGACCGGUUCACUGUCAAU | 181 | 76.6 | 105.6 |
| miR-374 | CUUAUCAGGUUGUAUUAUUAAU | 182 | 77.0 | 82.2 |
| miR-154star | UAGGUCAACCGUGUAUGAAUAU | 183 | 77.2 | 96.3 |
| miR-199b | ACAGAUAGUCUAAACACUGCGAU | 184 | 77.2 | 72.4 |
| miR-373star | AAAGCGCCCCCAUUUUGACUAU | 185 | 77.9 | 74.0 |
| miR-204 | GCAUAGGAUGACAAAGGGUAAU | 186 | 82.3 | 70.9 |
| miR-29b | UGAUUUCAAAUGGUGCAAAU | 187 | 82.4 | 78.7 |
| miR-338 | AACAAAAUCACUGAUGCUGCAAU | 188 | 83.6 | 64.7 |
| miR-324-5p | ACCAAUGCCCUAGGGGAUGGGAU | 189 | 84.3 | 60.3 |
| miR-182 | UGAGUUCUACCAUUGCUAAAAU | 190 | 84.5 | 128.1 |
| miR-369 | AGAUCAACCAUGUAUUAAUAU | 191 | 88.3 | 115.4 |
| miR-152 | AAGUUCUGUCAUGCACUCAAU | 192 | 93.0 | 96.1 |
| miR-302b | ACUAAAACAUGGAAGCACUAAAU | 193 | 94.4 | 100.9 |
| miR-181c | UCACCGACAGGUUGAAUGAUAU | 194 | 95.0 | 51.8 |
| miR-129 | AAGCCCAGACCGCAAAAUGAU | 195 | 98.9 | 116.2 |
| miR-30d | UCCAGUCGGGAUGUUUAUAAU | 196 | 99.9 | 77.0 |
| miR-138 | UUCACAACACCAGGUAU | 197 | 102.0 | 61.3 |
| miR-335 | AUUUUUCGUUAUUGCUCUUCAAU | 198 | 104.2 | 82.9 |
| miR-146 | CCCAUGGAAUUCAGUUUUUAAU | 199 | 105.6 | 81.4 |
| miR-198 | UAUCUCCCCUCUGGAGCAU | 200 | 108.8 | 153.2 |
| miR-27a | CGGAACUUAGCCACUGUGUAAU | 201 | 111.2 | 41.7 |
| miR-130a | CCUUUUAACAUUGCACAGAU | 202 | 111.3 | 102.2 |
| miR-224 | AACGGAACCACUAGUGACUAGAU | 203 | 111.6 | 99.0 |
| miR-181a | UCACCGACAGCGUUGAAUGAUAU | 204 | 111.8 | 105.4 |
| miR-186 | GCCCAAAAGGAGAAUUCUUUGAU | 205 | 114.7 | 113.8 |
| miR-367 | ACCAUUGCUAAAGUGCAAUUAU | 206 | 115.7 | 166.8 |
| miR-181b | CCCACCGACAGCAAUGAAUGUUAU | 207 | 117.0 | 102.1 |
| miR-126star | CGUACCAAAAGUAAUAAAGAU | 208 | 117.8 | 130.0 |
| miR-30c | UGAGAGUGUAGGAUGUUUAGAAU | 209 | 118.5 | 131.1 |
| miR-30a-3p | UGCAAACAUCCGACUGAAAGAU | 210 | 119.4 | 123.9 |
| miR-130b | GCCCUUUCAUCAUUGCACUGAU | 211 | 125.2 | 103.1 |
| miR-188 | CCUCCACCAUGCAAGGGAAGAU | 212 | 125.8 | 119.3 |

TABLE 7-continued miRNA Duplex

| miRNA Duplex | miRNA Antisense Oligo Sequence | SEQ ID NO: | % Control Viability (DLD-1 Dicerex5) | % Control Viability (HCT116 Dicerex5) |
|---|---|---|---|---|
| miR-185 | ACUGCCUUUCUCUUUAAU | 213 | 127.9 | 87.8 |
| miR-296 | AGGAUUGAGGGGGGUUUUAU | 214 | 130.7 | 126.5 |
| miR-150 | CUGGUACAAGGGUUGGGACAAU | 215 | 136.7 | 120.3 |
| miR-302d | ACUCAAACAUGGAAGCAUUUAAU | 216 | 137.4 | 139.9 |
| miR-302astar | AGCAAGUACAUCCACGUUUAAU | 217 | 138.2 | 64.9 |
| miR-219 | AAUUGCGUUUGGACAAUGAAU | 218 | 139.1 | 99.0 |
| miR-154 | AAGGCAACACGGAUAAUUUAAU | 219 | 144.9 | 153.2 |
| miR-187 | GCUGCAACACAAGACACCAAU | 220 | 144.9 | 125.6 |
| miR-373 | ACCCCAAAAUCGAAGCACUUCAU | 221 | 145.1 | 116.8 |
| miR-30a-5p | UUCCAGUCGAGGAUGUUUAGAAU | 222 | 149.3 | 142.0 |
| miR-340 | CUAUAAAGUAACUGAGACGCAAU | 223 | 149.4 | 124.0 |
| miR-136 | CAUCAUCAAAACAAAUGGACUAU | 224 | 150.8 | 100.8 |
| miR-302cstar | GCAGGUACCCCAUGUUAAAAU | 225 | 152.9 | 109.9 |
| miR-142-5p | AGUGCUUUCUACUUUAAGAU | 226 | 154.1 | 95.6 |
| miR-342 | CGGGUGCGAUUUCUGUGUGACAAU | 227 | 158.5 | 143.1 |
| miR-125a | CAGGUUAAAGGGUCUCAGGCAAU | 228 | 160.6 | 171.5 |
| miR-139 | ACACGUGCACUGUACAAU | 229 | 161.6 | 127.7 |
| miR-302bstar | AAAGCACUUCCAUGUUAAACUAU | 230 | 164.1 | 111.1 |
| miR-30b | UGAGUGUAGGAUGUUUAGAAU | 231 | 168.7 | 117.3 |
| miR-30e | CAGUCAAGGAUGUUUAGAAU | 232 | 169.0 | 124.2 |
| miR-99a | CAAGAUCGGAUCUACGGGAUAU | 233 | 202.2 | 169.5 |
| miR-301 | UUUGACAAUACUAUUGCACAGAU | 234 | 204.2 | 170.1 |
| miR-372 | GCUCAAAUGUCGCAGCACUUUAU | 235 | 207.7 | 176.6 |

Figure 5:
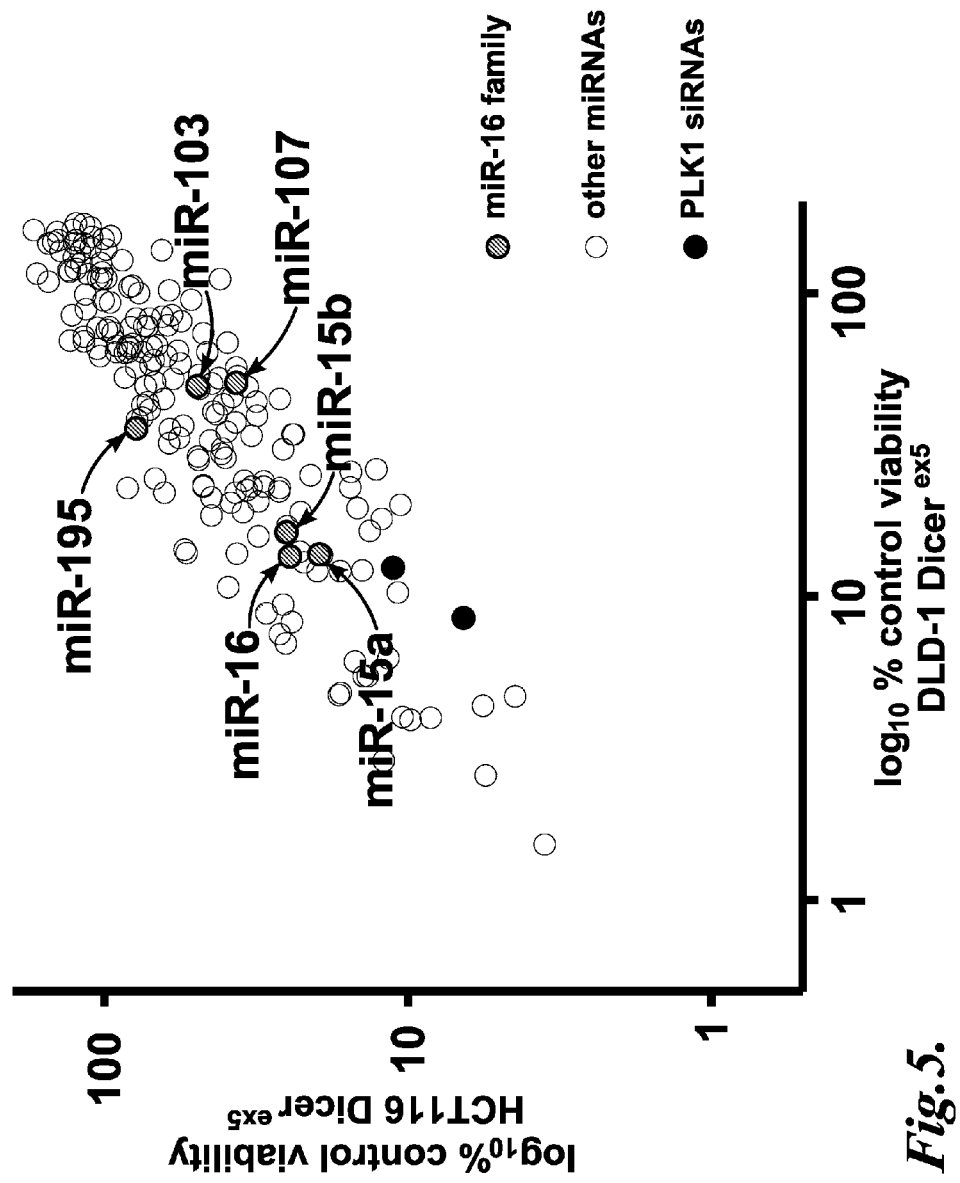
FIG. 5 graphically illustrates the percent viability of HCT116 Dicer$^{ex5}$ cells after transfection with a panel of microRNA duplexes, as described in EXAMPLE 3.

Results: TABLE 7 and FIG. 5 graphically illustrate the results of the 170+miRNA transfections. In FIG. 5 the x axis shows the $\log_{10}$% control viability of DLD-1 Dicer for each miRNA duplex or PLK siRNA pool ((% sample viability/% viability luciferase siRNA)*100). The y axis shows the $\log_{10}$% control viability of HCT116Dicer$^{ex5}$ for each miRNA duplex or PLK siRNA pool ((% sample viability/% viability luciferase siRNA)*100). The blue symbols represent siRNAs targeting PLK; the red symbols represent miR-16 family miRNAs (miR-15a, miR-15b, miR-16, miR-103, miR-107, and miR-195). The grey symbols represent other miRNAs (N=184).

As shown in TABLE 7 and FIG. 5, in both cell lines tested, miR-15a, miR-15b, and miR-16 inhibited cell growth in a four day assay by about 80%-85% as compared with luciferase siRNA-transfected cells. The degree of growth inhibition induced by the transfection of these miRNAs was similar to that observed with siRNAs targeting PKL1, an essential kinase. However, unlike PLK1 (Liu and Erikson, 2003, supra), miR-15a, miR-15b, and miR-16 did not induce apoptosis and cell death (data not shown) and, therefore, likely inhibit cell growth by a different mechanism.

It was also observed that miR-195 inhibited growth in DLD-1 Dicer$^{ex5}$ cells better than in HCT116 Dicer$^{ex5}$ cells (~60% vs. ~20%, respectively). In other experiments, growth inhibition by miR-195 was indistinguishable from that of miR-15a, miR-15b and miR-16 (data not shown). miR-103 and miR-107 were less effective at inhibiting cell growth in both cell lines tested. Of the other miRNAs that were analyzed by microarray profiling, shown in TABLE 7, miR-192, miR-215 and miR-133a gave stronger growth inhibitory phenotypes than miR-15a, miR-15b, and miR-16.

These results demonstrate that miR-15a, miR-15b, and miR-16 induce a measurable cellular phenotype consistent with their gene expression profiles. Because miR-15a, miR-15b, and miR-16 share seed region identity and induce identical expression profiles and cellular phenotypes, miR-16 was considered to be representative of the miR-16 family and was used for subsequent experiments.

EXAMPLE 4

This Example demonstrates that miR-16 regulates G0/G1 because cells transfected with miR-16 duplex had increased numbers of cells in G0/G1 and a corresponding decrease in S and G2/M.

Methods: HCT116Dicer$^{ex5}$ cells were transfected with miRNA duplexes for miR-106b (SEQ ID NO:18, 19), miR-16 (SEQ ID NO:30, 31), kshv-miR-K12-6-5p (SEQ ID NO:64, 65), kshv-mir-K12-3 (SEQ ID NO:66, 67), and miR-16 (SEQ ID NO:30, 31) containing mismatches at positions 2 and 3 (2, 3 mm) or 18 and 19 (18, 19 mm). Transfections were carried out as described in EXAMPLE 1.

24 hours after transfection, floating and adherent cells were harvested, combined, and processed. Alternatively, Nocodazole (100 ng/ml, Sigma-Aldrich) was added beginning at 20 hours post transfection, and cells were analyzed for cell cycle distribution 18 hours later (46 hours post transfection). Cells were collected by centrifugation, fixed with ice-cold 70% ethanol, washed with PBS, and resuspended in PBS containing Proridium Iodide (10 µg/ml) and RNAse A (1 mg/ml). After a final incubation at 37° C. for 30 minutes, cells were analyzed by flow cytometry using a FACSCalibur flow cytometer (Becton Dickinson). A total of 10,000 events were counted for each sample. Data was analyzed using FlowJo software (TreeStar, Ashland, Oreg.).

Results:

The fluorescence intensity of cells having diploid DNA content (2N), and cells having tetraploid DNA (4N) content was analyzed by FACS. The results are shown below in TABLE 8.

TABLE 8

| HCT116 Dicerex5 | 2N (% number of cells) | | | | 4N (number of cells) | | | |
|---|---|---|---|---|---|---|---|---|
| | −Nocodazole | | +Nocodazole | | −Nocodazole | | +Nocodazole | |
| Transfection | Exp 1 | Exp 2 | Exp 3 | Exp 4 | Exp 1 | Exp 2 | Exp 3 | Exp 4 |
| mock | 24 | 28.9 | | 4.76 | 30.4 | 21.4 | | 85.5 |
| luciferase | 29.6 | 29.9 | 5.07 | 5.02 | 28.5 | 24.2 | 80.3 | 82.5 |
| miR-16 | 60.3 | 55.4 | 27.3 | 41.8 | 19 | 15.6 | 59.9 | 44.8 |
| miR-106b | 25.7 | 26.1 | 3.01 | | 25.4 | 21.3 | 82 | |
| miR-16 2, 3 mismatch | 19 | 21.4 | | | 37.1 | 33.2 | | |
| miR-16 18, 19 mismatch | 63.6 | 55.2 | 24.9 | | 15.5 | 17.1 | 62.9 | |
| miR-K-12-3 | | | | 4.6 | | | | 82 |
| miR-K-12-6-5p | | | | 44.6 | | | | 44.7 |

As shown in TABLE 8, miR-106b transfected cells gave a cell cycle profile indistinguishable from mock or luciferase-transfected cells. miR-16 and viral miRNA kshv-miR-K12-6-5p which expresses a microRNA from the miR-16 family caused accumulation of cells at G0/G1 (2N DNA content). kshv-miR-6-5p therefore mimics the activity of a normal cellular microRNA family. In contrast, another KSHV miRNA, kshv-miR-K12-3, which does not express an miR-16 microRNA, had no observable effect on cell cycle distribution. It has been shown that kshv-miR-K12-6-5p is found in latently infected cells, so it is possible that miR-16 expression disrupts cell cycle control in Kaposi's sarcoma-associated herpes virus infected cells, which may play a role in the establishment or maintenance of latency (see Cai et al., *PNAS* 102:5570-5575 (2005); Verma, S. C., et al., *FEMS Microbiol Lett* 222:155-163 (2003)).

The G0/G1 accumulation phenotype observed in miR-16 transfected cells was reversed by paired seed region mismatches in miR-16 at positions 2+3 (and 4+5, not shown), but not by matches outside the seed region at positions 18+19 (and 19+20, not shown). It was also determined that miR-16 containing seed region mismatches at 2+3 and 4+5 triggered different expression profiles than miR-16, and the downregulated transcripts were found to be enriched for hexamers matching the mismatched seed regions (data not shown). Therefore, cell cycle and gene expression phenotypes induced by miR-16 are miRNA seed sequence-dependent.

The G0/G1 accumulation phenotype became clearer when the microtubule de-polymerizing drug, Nocodazole, was added before analysis to block cells from re-entering the cell cycle after mitosis. As shown in TABLE 8, Nocadazole treatment cause nearly all miR-106b transfected cells to accumulate in G2/M (4N DNA content), whereas a large fraction of miR-16-transfected cells remained in G0/G1. The extent of G0/G1 accumulation varied with the concentration of miR-16 transfected into cells, with clear effects seen at duplex concentrations of <1 nM (data not shown).

EXAMPLE 5

This Example demonstrates that transfection of siRNA pools directed to miR-16 consensus downregulated transcripts into HCT116 cells triggered G0/G1 accumulation of the transfected cells.

Methods:

Preparation of siRNA Pools siRNA sequences were designed with an algorithm developed to increase efficiency of the siRNAs for silencing while minimizing their off-target effects, as described in Jackson et al., *Nat Biotech* 21:635-637 (2003), incorporated herein by reference. siRNA duplexes were ordered from Sigma-Proligo (Boulder, Colo.). The siRNA sequences designed to target miR-16 consensus downregulated transcripts are provided below in TABLE 8.

Transfections: HCT116Dicer$^{ex5}$ cells were transfected with siRNA pools (with a separate transfection for each pool) targeting 102 identified downregulated consensus transcripts containing matches to the miR-16 seed region (miR-16 targets) and 51 control transcripts that did not contain miR-16 seed region matches (non-miR-16 targets). For the siRNA pools, three siRNAs targeting the same transcript were pooled at equal molarity (final concentration of each siRNA (17 nM); total siRNA concentration (50 nM)). Transfections were carried out as described in EXAMPLE 1. miR-16 was transfected as a positive control. The transfected cells were then analyzed for cell cycle distribution. To control for variation in transfection efficiency between different experiments, the percentages of cells in G0/G1 were normalized so that background control (the average of mock and luciferase-transfected cells) and miR-16 transfected (100 nM) cells gave 0% and 100% cells in G0/G1, respectively ((% G1sample-% G1background)/(% G1miR-16-% G1background)*100). Before normalization, background values averaged 6.4+1.1 (mean±SD) % cells in G0/G1, and miR-16-transfected cell values averaged 41+5% cells in G0/G1 (based on seven independent experiments).

The non-miR-16 targets tested were: EEA, FAM57A, GBP3, JUNB, L3 MBTL3, MAST2, NAGK, NBL, NUBP, PLAU, TNKS2, ADAM17, DUSP11, KHSRP, NDST2, PKP4, SQLE, SRP54, STX7, TAF2, TFR2, THOP1, TRAF3, TSPAN4, TSPAN6, TTC3, TTF2, USP1, UVRAG, YARS, RUVBL1, B4GALT3, MBTPS1, TNFSF10, ADAM9, MTMR1, PEX11B, SUCLA2, DPM2, PCAF, RAB7L1, OSMR, ARRB1, CRY1, DCTN1, STOM, FEN1, GNG11, SLC1A33.

TABLE 9 siRNA pools directed against miR-16 consensus transcripts
that induced cell cycle arrest at G0/G1 in transfected cells.

| siRNA Pools | Sense Sequence | Antisense Sequence (From Pool) | % G1 (Raw) (From Pool) | % G1 (Normalized) (From Pool) |
|---|---|---|---|---|
| ATG9A-1 | CAGAAGAAUGGCUUCA CAUdTdT (SEQ ID NO: 236) | AUGUGAAGCCA UUCUUCUGdTdT (SEQ ID NO: 237) | 19.9 | 45.4 |
| ATG9A-2 | GCUUAUCAAGUUCAUC UAUdTdT (SEQ ID NO: 238) | AUAGAUGAACU UGAUAAGCdTdT (SEQ ID NO: 239) | | |
| ATG9A-3 | GCUACAAGCCCGCCUCC AAdTdT (SEQ ID NO: 240) | UUGGAGGCGGG CUUGUAGCdTdT (SEQ ID NO: 241) | | |
| ATXN7L3-1 | GUCGAGAGCUCCCUGG AUAdTdT (SEQ ID NO: 242) | UAUCCAGGGAG CUCUCGACdTdT (SEQ ID NO: 243) | 19.9 | 45.4 |
| ATXN7L3-2 | GUCUGUGUGCAGAAUC UUAdTdT (SEQ ID NO: 244) | UAAGAUUCUGC ACACAGACdTdT (SEQ ID NO: 245) | | |
| ATXN7L3-3 | GACUCAGACCUGGACA UAUdTdT (SEQ ID NO: 246) | AUAUGUCCAGG UCUGAGUCdTdT (SEQ ID NO: 247) | | |
| C10orf46-1 | CAGAUGUAUAGUGAUC UGAdTdT (SEQ ID NO: 248) | UCAGAUCACUA UACAUCUGdTdT (SEQ ID NO: 249) | 15.7 | 33.1 |
| C10orf46-2 | GACAAUAUAUGGGAGC AUUdTdT (SEQ ID NO: 250) | AAUGCUCCCAUA UAUUGUCdTdT (SEQ ID NO: 251) | | |
| C10orf46-3 | GCUGUUUACGGAACAU GUUdTdT (SEQ ID NO: 252) | AACAUGUUCCG UAAACAGCdTdT (SEQ ID NO: 253) | | |
| IPPK-1 | GCUAUGUGCCUUCCUA AUUdTdT (SEQ ID NO: 254) | AAUUAGGAAGG CACAUAGCdTdT (SEQ ID NO: 255) | 18.6 | 42.1 |
| IPPK-2 | CACUUUGCCUUGAAGA GUUdTdT (SEQ ID NO: 256) | AACUCUUCAAG GCAAAGUGdTdT (SEQ ID NO: 257) | | |
| IPPK-3 | GCUGAAUGAUAGAGAU AUUdTdT (SEQ ID NO: 258) | AAUAUCUCUAU CAUUCAGCdTdT (SEQ ID NO: 259) | | |
| C9orf42-1 | CUCAUCCUGAGACUUU CUUdTdT (SEQ ID NO: 260) | AAGAAAGUCUC AGGAUGAGdTdT (SEQ ID NO: 261) | 16.7 | 36.2 |
| C9orf42-2 | GGAUUGCCUCCAAGCCC UAdTdT (SEQ ID NO: 262) | UAGGGCUUGGA GGCAAUCCdTdT (SEQ ID NO: 263) | | |
| C9orf42-3 | GCUUUCUUCUGACGUU GCAdTdT (SEQ ID NO: 264) | UGCAACGUCAG AAGAAAGCdTdT (SEQ ID NO: 265) | | |
| C9orf91-1 | CAGUGUUUGGCGGCUA CUAdTdT (SEQ ID NO: 266) | UAGUAGCCGCCA AACACUGdTdT (SEQ ID NO: 267) | 31.9 | 87.7 |
| C9orf91-2 | GUGUGAUUCAGCUUUG GUUdTdT (SEQ ID NO: 268) | AACCAAAGCUG AAUCACAdTdT (SEQ ID NO: 269) | | |
| C9orf91-3 | GGCCUAUGCGGCUGGC CUUdTdT (SEQ ID NO: 270) | AAGGCCAGCCGC AUAGGCCdTdT (SEQ ID NO: 271) | | |

TABLE 9-continued siRNA pools directed against miR-16 consensus transcripts that induced cell cycle arrest at G0/G1 in transfected cells.

| siRNA Pools | Sense Sequence | Antisense Sequence (From Pool) | % G1 (Raw) | % G1 (Normalized) |
|---|---|---|---|---|
| CARD10-1 | GACAUCACAGGGAGUGUGAdTdT (SEQ ID NO: 272) | UCACACUCCCUGUGAUGUCdTdT (SEQ ID NO: 273) | 38.8 | 104.3 |
| CARD10-2 | GUUCUCAUGGGCAGGCUCAdTdT (SEQ ID NO: 274) | UGAGCCUGCCCAUGAGAACdTdT (SEQ ID NO: 275) | | |
| CARD10-3 | CAGUUUGGUGCGGCCGCUAdTdT (SEQ ID NO: 276) | UAGCGGCCGCACCAAACUGdTdT (SEQ ID NO: 277) | | |
| CBX6-1 | CGUCUGAUUUCUCGGUGCUdTdT (SEQ ID NO: 278) | AGCACCGAGAAAUCAGACGdTdT (SEQ ID NO: 279) | 14.3 | 28.8 |
| CBX6-2 | CAUUGCAGCCUUCGAACAAdTdT (SEQ ID NO: 280) | UUGUUCGAAGGCUGCAAUGdTdT (SEQ ID NO: 281) | | |
| CBX6-3 | CCAAUGUGGUCGUCACCGAdTdT (SEQ ID NO: 282) | UCGGUGACGACCACAUUGGdTdT (SEQ ID NO: 283) | | |
| CDC27-1 | GAUAUCAACCCUCAAAGUUdTdT (SEQ ID NO: 284) | AACUUUGAGGGUUGAUAUCdTdT (SEQ ID NO: 285) | 14.6 | 29.7 |
| CDC27-2 | CCAAAGAAUCCCUCGUUUAdTdT (SEQ ID NO: 286) | UAAACGAGGGAUUCUUUGGdTdT (SEQ ID NO: 287) | | |
| CDC27-3 | CCUCUAUGCAAAUUUCACAdTdT (SEQ ID NO: 288) | UGUGAAAUUUGCAUAGAGGdTdT (SEQ ID NO: 289) | | |
| CDK6-1 | GUUGGCAGGUGACUUUGUAdTdT (SEQ ID NO: 290) | UACAAAGUCACCUGCCAACdTdT (SEQ ID NO: 291) | 13.0 | 24.8 |
| CDK6-2 | CCCAAGAAGCAGUGUGGAAdTdT (SEQ ID NO: 292) | UUCCACACUGCUUCUUGGGdTdT (SEQ ID NO: 293) | | |
| CDK6-3 | CUUAUUCCGUUUGCUUAUAdTdT (SEQ ID NO: 294) | UAUAAGCAAACGGAAUAAGdTdT (SEQ ID NO: 295) | | |
| COX10-1 | GUGUAUGAUUUGCCAGGAAdTdT (SEQ ID NO: 296) | UUCCUGGCAAAUCAUACACdTdT (SEQ ID NO: 297) | 17.1 | 35.5 |
| COX10-2 | CGCAUUUCUCCUGGGAGGAdTdT (SEQ ID NO: 298) | UCCUCCCAGGAGAAAUGCGdTdT (SEQ ID NO: 299) | | |
| COX10-3 | GCUUCUACGUGGACGCAGAdTdT (SEQ ID NO: 300) | UCUGCGUCCACGUAGAAGCdTdT (SEQ ID NO: 301) | | |
| H2AFX-1 | CAGUGUACCUGGCGGCAGUdTdT (SEQ ID NO: 302) | ACUGCCGCCAGGUACACUGdTdT (SEQ ID NO: 303) | 18.1 | 40.5 |
| H2AFX-2 | GUGCUUAGCCCAGGACUUUdTdT (SEQ ID NO: 304) | AAAGUCCGGGCUAAGCACdTdT (SEQ ID NO: 305) | | |
| H2AFX-3 | CACUUGGUAACAGGCACAUdTdT (SEQ ID NO: 306) | AUGUGCCUGUUACCAAGUGdTdT (SEQ ID NO: 307) | | |

TABLE 9-continued siRNA pools directed against miR-16 consensus transcripts that induced cell cycle arrest at G0/G1 in transfected cells.

| siRNA Pools | Sense Sequence | Antisense Sequence | % G1 (Raw) (From Pool) | % G1 (Normalized) (From Pool) |
|---|---|---|---|---|
| KIAA0317-1 | CACAAUUACACCUUGU CCAdTdT (SEQ ID NO: 308) | UGGACAAGGUG UAAUUGUGdTdT (SEQ ID NO: 309) | 29.5 | 75.7 |
| KIAA0317-2 | CUUUGAGCUUGCCGCA CGUdTdT (SEQ ID NO: 310) | ACGUGCGGCAA GCUCAAAGdTdT (SEQ ID NO: 311) | | |
| KIAA0317-3 | CAUAGGACUGCGUAUG CAUdTdT (SEQ ID NO: 312) | AUGCAUACGCA GUCCUAUGdTdT (SEQ ID NO: 313) | | |
| MFN2-1 | ACGUCAACUUGCUGAC ACAdTdT (SEQ ID NO: 314) | UGUGUCAGCAA GUUGACGUdTdT (SEQ ID NO: 315) | 19.8 | 40.7 |
| MFN2-2 | GUGAUGUGGCCCAACU CUAdTdT (SEQ ID NO: 316) | UAGAGUUGGGC CACAUCACdTdT (SEQ ID NO: 317) | | |
| MFN2-3 | CGGGUGACGUCAACUU GCUdTdT (SEQ ID NO: 318) | AGCAAGUUGAC GUCACCCGdTdT (SEQ ID NO: 319) | | |
| PHF17-1 | CCUGUUAUGGAAUCCU CAAdTdT (SEQ ID NO: 320) | UUGAGGAUUCC AUAACAGGdTdT (SEQ ID NO: 321) | 19.5 | 39.8 |
| PHF17-2 | ACAUCUUUCCCAUUAG CUCdTdT (SEQ ID NO: 322) | GAGCUAAUGGG AAAGAUGUdTdT (SEQ ID NO: 323) | | |
| PHF17-3 | GAAGUCAAGUUCAAGU CCUdTdT (SEQ ID NO: 324) | AGGACUUGAAC UUGACUUCdTdT (SEQ ID NO: 325) | | |
| PPP1R11-1 | GAGACAACGGUUACCG UGAdTdT (SEQ ID NO: 326) | UCACGGUAACC UUGUCUCdTdT (SEQ ID NO: 327) | 15.3 | 26.6 |
| PPP1R11-2 | GUCACUGAGACAACGG UUAdTdT (SEQ ID NO: 328) | UAACCGUUGUC UCAGUGACdTdT (SEQ ID NO: 329) | | |
| PPP1R11-3 | GUGUCUGUCUGGCCCU AAAdTdT (SEQ ID NO: 330) | UUUAGGGCCAG ACAGACACdTdT (SEQ ID NO: 331) | | |
| RAB11FIP2-1 | CACCUAAUGCAUUUAG UGAdTdT (SEQ ID NO: 332) | UCACUAAAUGC AUUAGGUGdTdT (SEQ ID NO: 333) | 14.3 | 25.6 |
| RAB11FIP2-2 | CAGAAAGUGGAAGUCU CAAdTdT (SEQ ID NO: 334) | UUGAGACUUCC ACUUUCUGdTdT (SEQ ID NO: 335) | | |
| RAB11FIP2-3 | GUAUCGUAGUCUGACC UAUdTdT (SEQ ID NO: 336) | AUAGGUCAGAC UACGAUACdTdT (SEQ ID NO: 337) | | |
| SRPR-1 | GUUUGUAGGAGAAGCC UUAdTdT (SEQ ID NO: 338) | UAAGGCUUCUCC UACAAACdTdT (SEQ ID NO: 339) | 16.6 | 33.7 |
| SRPR-2 | GUGUAGACAUGCUCCG GGAdTdT (SEQ ID NO: 340) | UCCCGGAGCAUG UCUACACdTdT (SEQ ID NO: 341) | | |
| SRPR-3 | CAAACUCAUUACUGUC AAUdTdT (SEQ ID NO: 342) | AUUGACAGUAA UGAGUUUGdTdT (SEQ ID NO: 343) | | |

TABLE 9-continued siRNA pools directed against miR-16 consensus transcripts
that induced cell cycle arrest at G0/G1 in transfected cells.

| siRNA Pools | Sense Sequence | Antisense Sequence | % G1 (Raw) (From Pool) | % G1 (Normalized) (From Pool) |
| --- | --- | --- | --- | --- |
| PCMT-1 | CUUAUGAUGCCAUUCA UGUdTdT (SEQ ID NO: 374) | ACAUGAAUGGC AUCAUAAGdTdT (SEQ ID NO: 375) | 14.6 | 24.4 |
| PCMT-2 | CAUACAUGGAUUCUCC ACAdTdT (SEQ ID NO: 376) | UGUGGAGAAUC CAUGUAUGdTdT (SEQ ID NO: 377) | | |
| PCMT-3 | CAGUUAAAGCCCGGAG GAAdTdT (SEQ ID NO: 378) | UUCCUCCGGGCU UUAACUGdTdT (SEQ ID NO: 379) | | |
| USP15-1 | CUCUUGAGAAUGUGCC GAUdTdT (SEQ ID NO: 380) | AUCGGCACAUUC UCAAGAGdTdT (SEQ ID NO: 381) | 13.7 | 23.52 |
| USP15-2 | CACAUUGAUGGAAGGU CAAdTdT (SEQ ID NO: 382) | UUGACCUUCCA UCAAUGUGdTdT (SEQ ID NO: 383) | | |
| USP15-3 | GUCCAAAGCAGCAUAU GUAdTdT (SEQ ID NO: 384) | UACAUAUGCUG CUUUGGACdTdT (SEQ ID NO: 385) | | |
| RCE-1 | GACCUAUGCUCCUGGG AUAdTdT (SEQ ID NO: 386) | UAUCCCAGGAGC AUAGGUCdTdT (SEQ ID NO: 387) | 13.7 | 21.56 |
| RCE-2 | GUCAUCAAGCGACGCU UCAdTdT (SEQ ID NO: 388) | UGAAGCGUCGC UUGAUGACdTdT (SEQ ID NO: 389) | | |
| RCE-3 | CUCUCUAUGGAUUGCC CUUdTdT (SEQ ID NO: 390) | AAGGGCAAUCC AUAGAGAGdTdT (SEQ ID NO: 391) | | |
| C20orf29-1 | CGCAUUGAGGGCAUCC UCAdTdT (SEQ ID NO: 392) | UGAGGAUGCCC UCAAUGCGdTdT (SEQ ID NO: 393) | 11.9 | 21.49 |
| C20orf29-2 | GCCUUUGCCGAGUGCU GUAdTdT (SEQ ID NO: 394) | UACAGCACUCGG CAAAGGCdTdT (SEQ ID NO: 395) | | |
| C20orf29-3 | CUUUCCGCCUGGCAGCA GAdTdT (SEQ ID NO: 396) | UCUGCUGCCAGG CGGAAAGdTdT (SEQ ID NO: 397) | | |
| HSPA1B-1 | GGCCUUUCCAGGUGAU CAAdTdT (SEQ ID NO: 398) | UUGAUCACCUG GAAAGGCCdTdT (SEQ ID NO: 399) | 11.9 | 21.49 |
| HSPA1B-2 | CCGAGAAGGACGAGUU UGAdTdT (SEQ ID NO: 400) | UCAAACUCGUCC UUCUCGGdTdT (SEQ ID NO: 401) | | |
| HSPA1B-3 | CGCAGAACACCGUGUU UGAdTdT (SEQ ID NO: 402) | UCAAACACGGU GUUCUGCGdTdT (SEQ ID NO: 403) | | |
| NOD9-1 | CAGGUGUUGCCGUGCU AAUdTdT (SEQ ID NO: 404) | AUUAGCACGGC AACACCUGdTdT (SEQ ID NO: 405) | 12.8 | 20.35 |
| NOD9-1 | GUCCUAUUGCUGGCUC GUUdTdT (SEQ ID NO: 406) | AACGAGCCAGCA AUAGGACdTdT (SEQ ID NO: 407) | | |

TABLE 9-continued siRNA pools directed against miR-16 consensus transcripts
that induced cell cycle arrest at G0/G1 in transfected cells.

| siRNA Pools | Sense Sequence | Antisense Sequence | % G1 (Raw) (From Pool) | % G1 (Normalized) (From Pool) |
|---|---|---|---|---|
| NOD9-1 | GCAAGUACGUGGGCCG CUAdTdT (SEQ ID NO: 408) | UAGCGGCCCACG UACUUGCdTdT (SEQ ID NO: 409) | | |
| miR-16 | SEQ ID NO: 30 | SEQ ID NO: 31 | 41.2 | 100.00 |

Figure 6:
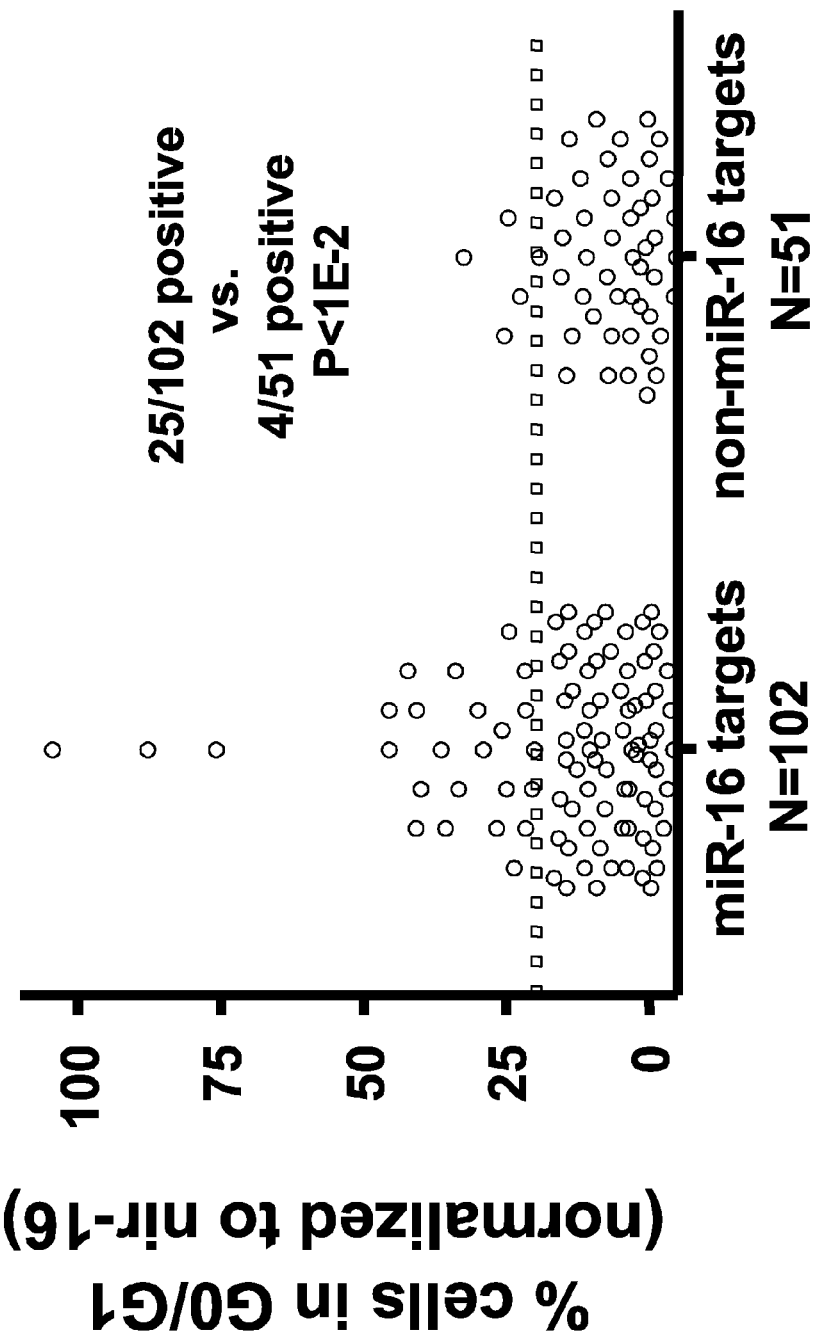
FIG. 6 graphically illustrates the percentage of HCT116Dicer$^{ex5}$ cells accumulated in G0/G1 after transfection with siRNA pools specifically targeting 102 transcripts containing miR-16 responsive target sites (miR-16 targets) and siRNA pools specifically targeting 51 transcripts that do not contain miR-16 responsive target sites (non-miR-16 targets), as described in EXAMPLE 5.
Figure 7C:
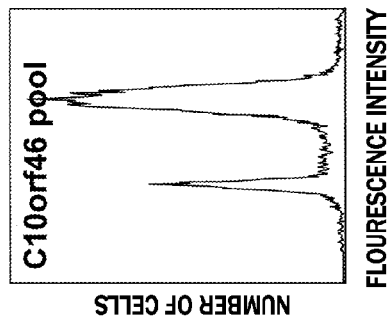
FIGS. 7A-E graphically illustrates the percentage of HCT116Dicer$^{ex5}$ cells accumulated in G0/G1 after transfection with siRNA pools directed to selected miR-16 downregulated gene targets in comparison to cells transfected with miR-16, as described in EXAMPLE 6.
Figure 7F:
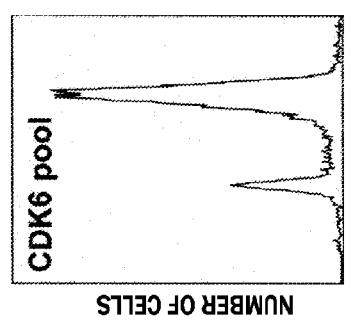
FIG. 7F illustrates the percentage of HCT116Dicer$^{ex5}$ cells accumulated in G0/G1 after transfection with an siRNA pool directed to CDK6.
Figure 7B:
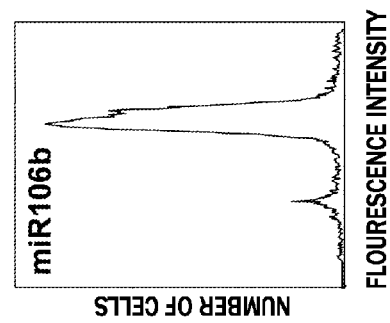
Figure 7E:
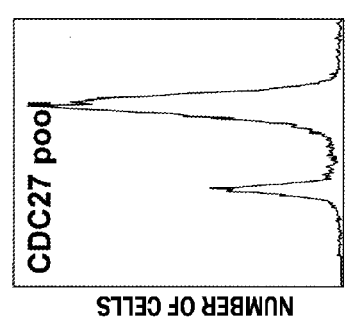
Figure 7A:
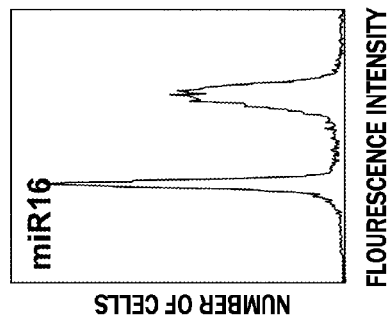
Figure 7D:
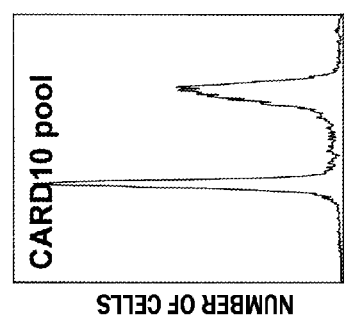

Results: The HCT116Dicer$^{ex5}$ transfection results of siRNA pools directed against miR-16 consensus transcripts are shown above in TABLE 9. FIG. 6 graphically shows the data presented in TABLE 9 as normalized percentages of cells in G0/G1 for each siRNA pool (shown as dots). The dotted line in FIG. 6 indicates a cut-off value of 20%, chosen statistically to maximize the recovery of miR-16 targets while maintaining the significance of the difference between miR-16 targets and non-miR-16 targets.

As shown in FIG. 6, 25 of the 102 transfected siRNA pools (~25%) targeting miR-16 downregulated miR-16 consensus transcripts, triggered G0/G1 accumulation in ≥20% of the cells, and therefore phenocopy the miR-16 phenotype. In contrast, only 4 of the 51 siRNA pools (~8%) targeting transcripts that did not match the miR-16 seed region (~8%) triggered G0/G1 accumulation (p<0.01, Fisher's exact test). These experiments demonstrate that significantly more miR-16 targets than non-miR-16 targets affect G0/G1 cell cycle transition.

EXAMPLE 6

This Example demonstrates that pools of siRNAs transfected into cells are capable of inducing the same phenotype as miR-16 transfected into cells.

Methods:

siRNA pools were selected for further analysis: CARD10-1 (104.3% G1 in TABLE 9), CDC27-1 (29.7%), CDK6-1 (24.8%), C10orf46 (33.1%). MiR-16, miR-106(b) control duplex and siRNA pools targeting CARD10, CDC27-1, CDK6-1 and C10orf46, were each transfected into HCT116Dicer$^{ex5}$ cells (3 siRNAs per pool, each at 33 nM; 100 nM total concentration). Cell cycle analysis was carried out using FACs as described above in EXAMPLE 4.

Results of siRNA transfected pools: As shown in FIGS. 7A-E, cells transfected with siRNA pools directed against c10orf46, CARD10, CDC27 and CDK6 phenocopied the G0/G1 phenotype observed in the miR16 transfected cells.

Transfection of Individual siRNAs:

siRNAs to selected miR-16 downregulated targets that induced G0/G1 accumulation, shown below in TABLE 10, were individually transfected into HCT116Dicer$^{ex5}$ cells at 0.25 nM. The percent of cells in G1 was determined as described in EXAMPLE 4.

mRNA silencing was quantified at 48 hours by real-time PCR using an ABI PRISM 7900HT Sequence Detection System and Assays-on-Demand gene expression products (Applied Biosystems, Foster City, Calif.). The mRNA value for each gene was normalized relative to GUSB (No. 431088E) mRNA levels in each RNA sample.

Protein products of targeted transcripts CDK6 and CDC27 were also measured in siRNA transfected cells. Immunoblotting was performed as described in Jackson et al., RNA 12(7): 1-8 (2006). Anti-CDK6 monoclonal antibody (DCS-90) was purchased from Abcam (Cambridge, Mass.).

A subset of miR-16 targets CDK6, CARD10, CDC27 and C10orf46 were chosen for analysis. For each of these targets, at least 2 siRNAs were identified that induced G0/G1 accumulation in greater than 20% of the cells (CDK6 (2/3); CARD10 (2/3); CDC27(2/6); and C10orf46 (2/6) individual siRNAs tested). mRNA silencing data for these siRNAs was also determined, as shown in TABLE 10. In all cases, it was determined that siRNAs inducing the strongest cell cycle phenotypes also silenced the mRNA of their targets the most, as determined by the % mRNA remaining.

TABLE 10

Individual siRNAs Targeting miR-16 Consensus Downregulated Transcripts

| | | | Exp 1 | | | Exp 2 | |
|---|---|---|---|---|---|---|---|
| siRNA | Sense Sequence | Antisense Sequence | % G1 raw | % G1 normalized | % mRNA remaining | % G1 raw (0.25 nM) | % G1 normalized (0.25 nM) |
| APG9L1-1 | see above | see above | 43.3 | 109.4 | | 8.82 | 13.4 |
| APG9L1-2 | see above | see above | 15.2 | 29.3 | | | |
| APG9L1-3 | see above | see above | 22.8 | 51.0 | | | |
| ATXN7L3-1 | see above | see above | 28.6 | 67.5 | | 6.12 | 2.0 |
| ATXN7L3-2 | see above | see above | 9.7 | 13.5 | | | |
| ATXN7L3-3 | see above | see above | 27.5 | 64.4 | | | |

TABLE 10-continued

Individual siRNAs Targeting miR-16 Consensus Downregulated Transcripts

| siRNA | Sense Sequence | Antisense Sequence | Exp 1 % G1 raw | Exp 1 % G1 normalized | Exp 1 % mRNA remaining | Exp 2 % G1 raw (0.25 nM) | Exp 2 % G1 normalized (0.25 nM) |
|---|---|---|---|---|---|---|---|
| C10orf46-1 | see above | see above | 7.1 | 6.5 | 8.3 | | |
| C10orf46-2 | see above | see above | 7.2 | 6.8 | 11.2 | | |
| C10orf46-3 | see above | see above | 33.7 | 84.5 | 12.2 | 6.49 | 3.5 |
| C10orf46-4 | CCAUUUCAGGUC ACACCUUdTdT (SEQ ID NO: 344) | AAGGUGUGACCU GAAAUGGdTdT (SEQ ID NO: 345) | 15.4 | 21.2 | 17.0 | | |
| C10orf46-5 | CAGAUAUACAGU UGUGUGUdTdT (SEQ ID NO: 346) | ACACACAACUGUA UAUCUGdTdT (SEQ ID NO: 347) | 8.9 | 0.3 | 13.6 | | |
| C10orf46-6 | GAACUUAUACAG AAUGGUUdTdT (SEQ ID NO: 348) | AACCAUUCUGUA UAAGUUCdTdT (SEQ ID NO: 349) | 6.0 | -8.8 | 23.4 | | |
| C20orf29-1 | see above | see above | 7.8 | 8.5 | 14.9 | | |
| C20orf29-2 | see above | see above | 29.4 | 71.9 | 37.8 | | |
| C20orf29-3 | see above | see above | 14.5 | 28.2 | 26.8 | 4.78 | -3.7 |
| C20orf29-4 | CACACGCUGUC AGAGGAUGdTdT (SEQ ID NO: 410) | CAUCCUCUGACA GCGUGUGdTdT (SEQ ID NO: 411) | 6.4 | -7.7 | 71.7 | | |
| C20orf29-5 | GGCGUGCUCUC GUUAGGCUdTdT (SEQ ID NO: 412) | AGCCUAACGAGA GCACGCCdTdT (SEQ ID NO: 413) | 6.8 | -6.3 | 26.4 | | |
| C20orf29-6 | GGGACAGGCUU CUCCGGAAdTdT (SEQ ID NO: 414) | UUCCGGAGAAGC CUGUCCCdTdT (SEQ ID NO: 415) | 43.7 | 111.9 | 45.1 | | |
| C9orf12-1 | see above | see above | 10.0 | 14.9 | 16.8 | | |
| C9orf12-2 | see above | see above | 5.0 | 0.2 | 46.9 | | |
| C9orf12-3 | see above | see above | 13.7 | 25.8 | 20.3 | 6.39 | 3.1 |
| C9orf42-1 | see above | see above | 6.1 | 3.7 | 21.6 | | |
| C9orf42-2 | see above | see above | 10.4 | 16.1 | 18.6 | 6.33 | 2.8 |
| C9orf42-3 | see above | see above | 9.4 | 13.2 | 9.2 | | |
| C9orf91-1 | see above | see above | 26.6 | 61.8 | | | |
| C9orf91-2 | see above | see above | 50.2 | 129.1 | | 5.33 | -1.4 |
| C9orf91-3 | see above | see above | 6.5 | 4.5 | | | |
| CARD10-1 | see above | see above | 21.0 | 47.2 | 23.5 | | |
| CARD10-2 | see above | see above | 5.9 | 2.9 | 120.3 | | |
| CARD10-3 | see above | see above | 11.8 | 20.2 | 42.2 | | |
| CARD10-4 | CACACGCUGUC AGAGGAUGdTdT (SEQ ID NO: 350) | CAUCCUCUGACA GCGUGUGdTdT (SEQ ID NO: 351) | 32.8 | 76.9 | 36.3 | 7.61 | 8.3 |
| CARD10-5 | GAGACCUGUUG AGGAAGUCdTdT (SEQ ID NO: 352) | GACUUCCUCAAC AGGUCUCdTdT (SEQ ID NO: 353) | 13.2 | 14.1 | 36.5 | | |

TABLE 10-continued

Individual siRNAs Targeting miR-16 Consensus Downregulated Transcripts

| siRNA | Sense Sequence | Antisense Sequence | Exp 1 % G1 raw | Exp 1 % G1 normalized | Exp 1 % mRNA remaining | Exp 2 % G1 raw (0.25 nM) | Exp 2 % G1 normalized (0.25 nM) |
|---|---|---|---|---|---|---|---|
| CARD10-9 | CGAAUAGCCAG AGACCUGUdTdT (SEQ ID NO: 354) | ACAGGUCUCUGG CUAUUCGdTdT (SEQ ID NO: 355) | 16.4 | 24.4 | 48.1 | | |
| CBX6-1 | see above | see above | 5.1 | 0.5 | 11.1 | | |
| CBX6-2 | see above | see above | 5.4 | 1.6 | 13.6 | | |
| CBX6-3 | see above | see above | 27.1 | 65.1 | 26.9 | 7.37 | 7.3 |
| CBX6-4 | CAUCGAGUACCU GGUGAAAdTdT (SEQ ID NO: 416) | UUUCACCAGGUA CUCGAUGdTdT (SEQ ID NO: 417) | 6.3 | −8.0 | 107.7 | | |
| CBX6-5 | GUCUUCGCGGGC CGAAUCCAdTdT (SEQ ID NO: 418) | UGGAUUCGGCC GCGAAGACdTdT (SEQ ID NO: 419) | 21.1 | 39.4 | 35.3 | | |
| CBX6-6 | CCAUUUCGCCCU UCUCGGAdTdT (SEQ ID NO: 420) | UCCGAGAAGGG CGAAAUGGdTdT (SEQ ID NO: 421) | 6.3 | −8.0 | 25.7 | | |
| CDC27-1 | see above | see above | 4.7 | −0.5 | 17.7 | | |
| CDC27-2 | see above | see above | 6.4 | 4.4 | 20.6 | | |
| CDC27-3 | see above | see above | 31.9 | 79.2 | 26.3 | 8.19 | 10.7 |
| CDC27-4 | GAUUAAAGAGGC AAUUGAUdTdT (SEQ ID NO: 356) | AUCAAUUGCCUCUC UUUAAUCdTdT (SEQ ID NO: 357) | 9.1 | 1.0 | 20.2 | | |
| CDC27-5 | GCGUUAUCUUCC AGAUGAUdTdT (SEQ ID NO: 358) | AUCAUCUGGAAG AUAACGCdTdT (SEQ ID NO: 359) | 27.8 | 60.9 | 22.2 | | |
| CDC27-6 | CACUAAUACACC UCCUGUAdTdT (SEQ ID NO: 360) | UACAGGAGGUGU AUUAGUGdTdT (SEQ ID NO: 361) | 5.2 | −11.7 | 25.6 | | |
| CDK6-1 | see above | see above | 15.2 | 30.2 | 25.0 | | |
| CDK6-2 | see above | see above | 6.5 | 4.8 | 26.5 | | |
| CDK6-3 | see above | see above | 20.2 | 44.9 | 24.7 | 10.1 | 18.9 |
| COX10-1 | see above | see above | 36.8 | 90.9 | | | |
| COX10-2 | see above | see above | 10.9 | 17.0 | | | |
| COX10-3 | see above | see above | 5.3 | 1.0 | | | |
| H2AFX-1 | see above | see above | 21.8 | 49.6 | 215.1 | | |
| H2AFX-2 | see above | see above | 6.9 | 5.8 | 153.2 | | |
| H2AFX-3 | see above | see above | 5.7 | 2.4 | 89.5 | | |
| H2AFX-4 | CCUCCAUCUUCA UUCAUAGdTdT (SEQ ID NO: 422) | CUAUGAAUGAAG AUGGAGGdTdT (SEQ ID NO: 423) | 32.8 | 76.9 | 43.6 | | |
| H2AFX-5 | GGACGAAGCAC UUGGUAACdTdT (SEQ ID NO: 424) | GUUACCAAGUGC UUCGUCCdTdT (SEQ ID NO: 425) | 18.6 | 31.4 | 23.3 | 5.62 | −0.2 |
| H2AFX-6 | GGCACAUCUUCC UCCCGAGdTdT (SEQ ID NO: 426) | CUCGGGAGGAA AUGUGCCdTdT (SEQ ID NO: 427) | 12.7 | 12.5 | 26.3 | | |

TABLE 10-continued

Individual siRNAs Targeting miR-16 Consensus Downregulated Transcripts

| siRNA | Sense Sequence | Antisense Sequence | Exp 1 % G1 raw | Exp 1 % G1 normalized | Exp 1 % mRNA remaining | Exp 2 % G1 raw (0.25 nM) | Exp 2 % G1 normalized (0.25 nM) |
|---|---|---|---|---|---|---|---|
| HSPA1B-1 | see above | see above | 5.8 | 2.7 | 67.2 | | |
| HSPA1B-2 | see above | see above | 9.4 | 13.1 | 59.1 | | |
| HSPA1B-3 | see above | see above | 12.1 | 21.1 | 66.9 | 5.79 | 0.6 |
| KIAA0317-1 | see above | see above | 41.1 | 106.2 | 104.3 | | |
| KIAA0317-2 | see above | see above | 6.3 | 4.1 | 91.1 | | |
| KIAA0317-3 | see above | see above | 13.1 | 24.1 | 72.7 | 5.39 | −1.1 |
| MFN2-1 | see above | see above | 8.4 | 9.9 | | | |
| MFN2-2 | see above | see above | 21.0 | 45.8 | | 6.68 | 4.3 |
| MFN2-3 | see above | see above | 35.8 | 88.0 | | | |
| NOD9-1 | see above | see above | 24.0 | 54.4 | | | |
| NOD9-2 | see above | see above | 8.9 | 11.2 | | | |
| NOD9-3 | see above | see above | 29.6 | 70.3 | | | |
| PCMT-1 | see above | see above | 17.0 | 34.4 | | 6.03 | 1.6 |
| PCMT-2 | see above | see above | 8.8 | 11.0 | | | |
| PCMT-3 | see above | see above | 7.4 | 7.0 | | | |
| PHF17-1 | see above | see above | 6.9 | 5.6 | | | |
| PHF17-2 | see above | see above | 6.5 | 4.5 | | | |
| PHF17-3 | see above | see above | 32.0 | 77.2 | | 6.98 | 5.6 |
| PPP1R1-1 | see above | see above | 4.7 | −0.7 | | | |
| PPP1R1-2 | see above | see above | 26.4 | 61.2 | | 7.5 | 7.8 |
| PPP1R1-3 | see above | see above | 12.4 | 21.3 | | | |
| RAB11FIP2-1 | see above | see above | 4.7 | −0.7 | | | |
| RAB11FIP2-2 | see above | see above | 11.9 | 19.9 | | | |
| RAB11FIP2-3 | see above | see above | 23.2 | 52.1 | | 9.42 | 16.0 |
| RCE-1 | see above | see above | 18.6 | 39.0 | | 7.17 | 6.4 |
| RCE-2 | see above | see above | 4.8 | −0.3 | | | |
| RCE-3 | see above | see above | 17.4 | 35.6 | | | |
| SRPR-1 | see above | see above | 23.1 | 51.8 | | 6.61 | 4.0 |
| SRPR-2 | see above | see above | 9.9 | 14.3 | | | |
| SRPR-3 | see above | see above | 9.2 | 12.2 | | | |
| USP15-1 | see above | see above | 14.4 | 27.0 | | | |
| USP15-2 | see above | see above | 22.5 | 50.1 | | 7.4 | 7.4 |
| USP15-3 | see above | see above | 11.6 | 19.0 | | | |
| luciferase | CGUACGCGGAAU ACUUCGAdTdT (SEQ ID NO: 362) | UCGAAGUAUUCC GCGUACGdTdT (SEQ ID NO: 363) | 6.4 | 0.0 | 0.0 | | |

TABLE 10-continued

Individual siRNAs Targeting miR-16 Consensus Downregulated Transcripts

|  |  |  | Exp 1 | | | Exp 2 | |
| --- | --- | --- | --- | --- | --- | --- | --- |
| siRNA | Sense Sequence | Antisense Sequence | % G1 raw | % G1 normalized | % mRNA remaining | % G1 raw (0.25 nM) | % G1 normalized (0.25 nM) |
| KIF11 | AAAGGACAACUG CAGCUACdTdT (SEQ ID NO: 364) | GUAGCUGCAGUU GUCCUUUdTdT (SEQ ID NO: 365) | | | | | |

Results: The 25 siRNA pools that gave >20% G0/G1 accumulation were deconvoluted and individual siRNAs (100 nM) were tested for their ability to phenocopy miR-16. miR-16 (1 nM and 100 nM) and miR-106b (100 nM) were transfected as controls. For 24 of the 25 pools, at least one individual member of the siRNA pool gave a phenotype as strong as the pool value. The results of the individually transfected siRNAs from each selected pool are shown above in TABLE 10 (Exp 1).

Individual siRNA molecules were then titrated to a concentration where most gave phenotypes only slightly above background (0.25 nM, compared to 100 nM total concentration used in FIG. 6). It was determined that none of the individual siRNAs at 0.25 nM triggered ≥20% normalized G0/G1 accumulation (at 0.25 nM), wheras a pool of all 24 siRNAs (Pool 1, 0.25 nM each, total concentration of 6 nM) triggered 73% normalized accumulation of cells at G0/G1.

An experiment was carried out in which individual siRNAs (0.25 nM) for CARD10-4, KIAA0317-3 and C9orf91-1, the three siRNAs that gave the strongest phenotype shown in FIG. 6, were transfected individually and as a pool (3-way combination at 0.25 nM each, 0.75 nM total). It was determined that each individual siRNA at a concentration of 0.25 nM triggered <30% G0/G1 normalized accumulation, but the pool of three siRNAs triggered ~50% normalized accumulation of cells at G0/G1. These experiments demonstrates that the robust cell cycle phenotype elicited by miR-16 results from coordinate silencing of multiple miR-16 responsive targets.

A subset of targets, including CDK6, CARD10, CDC27, and C10orf46, were chosen for further analysis. An experiment was conducted to demonstrate that the cell cycle phenotypes triggered by siRNAs to these targets resulted from silencing of these targets, and not due to indirect effects from unintended targets (see. e.g., Jackson et al., Nat Biotech 21:635-637 (2003)). As shown in TABLE 10, the siRNAs that triggered the strongest cell cycle phenotypes also generally were found to silence their targets the most, as determined by % mRNA remaining.

Another experiment was carried out in which pooled siR-NAs to two miR-16 targets (CDK6 and CDC27, each at 0.25 nM) or three miR-16 targets (CDK6, CDC27 and CARD10, each at 0.25 nM) were transfected into HCT116Dicer$^{ex5}$ cells. In each case, the pools gave a stronger phenotype than the individual siRNAs (at 0.25 nM) (data not shown).

These experiments suggested that the robust G0/G1 cell cycle phenotype elicited by miR-16 mediated regulation results from coordinated silencing of multiple miR-16 responsive targets.

EXAMPLE 7

This Example demonstrates the synergistic effect of transfecting a pool of siRNAs directed to different miR-16 responsive targets in comparison to transfection of the corresponding individual siRNAs.

Methods:
Transfection of Pooled siRNAs to Different miR-16 Responsive Targets

Individual siRNAs targeting CDK6 (siRNA=CDK6-3), CDC27 (siRNA=CDC27-3), CARD10 (siRNA=CARD10-4) and C10orf46 (siRNA=C10orf46-3) (shown in TABLE 11) were transfected into HCT116Dicer$^{ex5}$ cells at a concentration of 0.25 nM. These four siRNAs (CDK6-3, CDC27-3, CARD10-4 and C10orf46-3) were also transfected together as a pool (0.25 nM each siRNA, total concentration=1 nM). miR-16 and miR-106b were transfected as controls (1 nM each). Cell cycle phenotypes were determined by FACS analysis as described in EXAMPLE 4.

Results: As shown in FIGS. 8A-H, and TABLE 10, individual siRNAs targeting CDK6, CDC27, CARD10 and C10orf46 triggered minimal amounts of G0/G1 accumulation when transfected at 0.25 nM (shown as Exp 2). However, when these siRNAs were pooled, a much stronger, synergistic phenotype was observed. If the effects were merely additive, one would expect to find about 34% more cells (normalized value) in G0/G1 in pool-transfected than in control-transfected cells (18.9%+10.7%+8.3%−2.7%)=34.2 (see TABLE 10, Exp 2). However, when these siRNAs were pooled (pool A+B+C+D, total concentration, 1 nM), a greater than additive phenotype was observed (~61% normalized cells in G0/G1), as shown in FIG. 8E. Equivalent results were obtained when luciferase siRNA was added to individual siRNAs to maintain a total concentration of 1 nM (data not shown). Measurements of transcript silencing by quantitative PCR or immunoblotting, carried out as described in EXAMPLE 6, showed that silencing of target transcripts was maintained or slightly reduced when siRNAs were pooled (data not shown). siRNAs that did not induced G0/G1 accumulation when tested individually (CHEK1, C9orf42, C9orf12 and CBX6), did not induce G0/G1 accumulation when pooled, (data not shown). Taken together, these findings demonstrate that a plurality of miR-16 responsive genes function to regulate cell cycle progression from G0/G1 to S.

EXAMPLE 8

This example describes the cellular phenotype induced in cells transfected with miR-16 or miR-106b and in cells transfected with anti-miR-16 or anti-miR-106b.

Methods:
Cell Cycle Analysis

HCT116Dicer$^{ex5}$ cells were transfected with increasing concentrations of miR-16 duplex (SEQ ID NO:3) (0.5, 1, 10 and 100 nM), or plasmids carrying miR-16 expressed as an shRNA (miR-16 hairpin, Silva, et al., Nat Genet 37:1281-1288 (2005)), or from its endogenous locus on chromosome 13 (miR-16 locus). In both cases, expression of the precursor form of miR-16 was under the control of an H1 promoter. For transfections with plasmids, the DNA concentration was 1.5 µg DNA per $2 \times 10^5$ to $3 \times 10^5$ cells in a 6-well dish.

The transfected cells were treated with nocodazole and analyzed as described in EXAMPLE 4. The percentages of cells in G0/G1 in different experiments were normalized so that background control and miR-16-transfected cells gave 0% and 100% of cells in G0/G1, respectively [(the percentage of G1 cells in the sample—the percentage of background G1 cells)/(the percentage of G1 miR-16-transfected cells—the percentage of background G1 cells)×100].

For duplex transfections, mock-transfected cells were used to determine the percentage of background G1 cells. For plasmid transfections, cells transfected with an empty vector were used to determine the percentage of background G1 cells.

miR-16 copy numbers (copies/20 pg of RNA) were determined by a quantitative primer extension PCR assay (Raymond, C. K., et al., *RNA* 11:1737-1744 (2005)). This assay preferentially detects mature miR-16 over duplex and hairpin forms.

Results:

FIG. 9A graphically illustrates the percentage of HCT116Dicer$^{ex5}$ cells in G0/G1 after miR-16 transfection at various copies/20 pg. The miR-16 copy numbers shown in FIG. 9A are the means of quadruplicate determination that typically differed from the mean by <15%. The results shown are representative of results from at least two experiments for each form of miR-16. As shown in FIG. 9A, the percentage of cells in G0/G1 increased with rising concentrations of miR-16. The distinct accumulation of cells in G0/G1 was achieved with miR-16 duplex concentrations of 0.5 to 1nM, which resulted in miR-16 levels of ~3,500 to ~5,600 copies/20 pg, respectively. This compared with ~300 copies/20 pg measured with mock- or luciferase-transfected cells. Both the miR-16 shRNA and miR-16 locus consistently triggered a ~2-fold increase in the number of cells in G0/G1 and an increase in miR-16 levels to ~3,000 copies/20 pg. The miR-16 shRNA triggered identical results in HCT116 wild-type cells (data not shown), suggesting that the processing of the hairpin does not require full Dicer activity.

Transfection with empty vector and an shRNA for miR-106b did not result in the accumulation of cells in G0/G1 or miR-16 levels greater than those in mock-transfected cells (data not shown).

As shown in FIG. 9A, at equivalent miR-16 levels, the duplex was slightly less efficient at inducing the accumulation of cells in G0/G1. While not wishing to be bound by theory, these results are consistent with the idea that not all the duplex with which cells were transfected was accessible for incorporation into the RNA-induced silencing complex. The overexpression of miR-16 from hairpin precursors therefore triggered the accumulation of cells in the G0/G1 with a level of efficiency similar to that of the miR-16 duplex.

Inhibition of miR-16

Rationale: The following experiments were carried out in order to determine if the cellular phenotype induced by miR-16 over-expression experiments was reversed in loss-of-function experiments.

Methods:

HeLa cells, TOV21G, HCT116wild-type and HCT116Dicer$^{ex5}$ cells were transfected with luciferase siRNA, miR-16, miR-106b, and anti-miR-16 or anti-miR106b (LNA or 2'-O-methyl modified oligonucleotide inhibitors of miR-16 and miR-106b, Hutvagner, G. M., et al., *PloS Biol* 2:E98 (2004); Orom, U. A., et al., *Gene* 372:137-141 (2006)). Gene expression analysis was carried out on the transfected cells using microarrays as described in EXAMPLE 2.

Results:

FIGS. 9B and 9C are heatmap representations of miR-16 target gene expression, or miR-106b target gene expression, respectively, in HeLa cells after transfection with luciferase, miR-16, anti-miR-16, miR-106b or anti-miR-106b duplexes. As shown in FIG. 9B, miR-16 consensus transcripts were weakly, but detectably up-regulated by anti-miR-16 but not by anti-miR-106b. In HeLa cells, it appeared that nearly 100% of down-regulated targets were up-regulated by specific anti-miRs.

TABLE 11 and TABLE 12 summarize the gene expression results from transfected cells with anti-miR-16 or anti-miR-106b, respectively. For controls, patterns of regulation of randomized sets of genes were compared from luciferase siRNA-treated cells. The median change or median percentage of increase in regulation was compared. Control sets gave 0.01%+0.6% change. The # of up-regulated, percentage of miR-16 or miR-106b consensus targets having a level of regulation >0. Control sets gave 50%±5% of targets with a level of regulation of >0. For the up-regulation P value, Wilcoxon signed-rank P values for the up-regulation of the indicated target sets. Mitotic cell cycle genes, transcripts down-regulated by the miR-16 duplex at 24 h and annotated with the GO biological process term "mitotic cell cycle".

TABLE 11

Transfections with anti-miR-16 into various cell lines

| Cell line | miR-16 Consensus Targets | | | miR-106b Consensus Targets | | | Mitotic cell cycle genes up-regulation p-value |
|---|---|---|---|---|---|---|---|
| | median change (%) | # up-regulated (%) | up-regulation p-value | median change (%) | # up-regulated (%) | up-regulation p-value | |
| HeLa | 11 | 92 | 7.0E−19 | 3 | 71 | 1.0E−.05 | 8.0E−0.2 |
| TOV21G | 7 | 92 | 1.0E−18 | 1 | 58 | 3.0E−02 | 1.0E−0.8 |
| HCT116 wild type | 4 | 75 | 6.0E−12 | −1 | 42 | 1.0E00 | 1.0E−0.6 |
| HCT116 Dicer$^{ex5}$ | 2 | 69 | 4.0E−07 | 0 | 49 | 7.0E−0.1 | 5.0E−.04 |

TABLE 12

Transfections with anti-miR-106b into various cell lines

| | MiR-16 Consensus Targets | | | miR-106b Consensus Targets | | | Mitotic cell |
|---|---|---|---|---|---|---|---|
| Cell line | median change (%) | # up-regulated (%) | up-regulation p-value | median change (%) | # up-regulated (%) | up-regulation p-value | cycle genes up-regulation p-value |
| HeLa | 3 | 62 | 2.0E−04 | 17 | 95 | 8.0E−19 | 4.0E−0.1 |
| TOV21G | 0 | 52 | 2.0E−01 | 12 | 89 | 5.0E−17 | 7.0E−02 |
| HCT116 wild type | 2 | 61 | 2.0E−04 | 16 | 95 | 1.0E−18 | 4.0E−02 |
| HCT116 Dicerex5 | 3 | 70 | 5.0E−06 | 6 | 79 | 6.0E−13 | 4.0E−01 |

As shown above in TABLES 11 and 12, the median regulation of consensus miR-16 and miR-106b targets was slightly increased in cells transfected with the specific anti-miR. When considered as a group, miR-16 targets were more significantly up-regulated than miR-106b targets in cells treated with anti-miR-16 (see TABLE 11). Target regulation was greatly reduced in HCT116Dicer$^{ex5}$ cells, as expected given the reduced miRNA levels in these cells. Likewise, anti-miR-106b-treated cells showed significant regulation of miR-106b, but not miR-16 consensus targets (see TABLE 12). Taken together, these results indicate that in cells with wild-type Dicer function, many, if not most, miR-16 and miR-106b targets down-regulated by miRNA duplexes in gain-of-function experiments (as shown in FIGS. 9B and 9C) were up-regulated by specific anti-miRs in loss-of-function experiments.

As further shown in TABLE 11, miR-16-regulated transcripts annotated with the GO biological process term "mitotic cell cycle" (see TABLE 4) were significantly up-regulated by anti-miR-16 in TOV21G and HCT116 wild-type cells. These transcripts were less regulated in HeLa cells, which do not show an miR-16 cell cycle phenotype, and in HCT116Dicer$^{ex5}$ cells, which have reduced endogenous levels of miR-16. As shown in TABLE 12, mitotic cell cycle transcripts were not significantly regulated in any cell line by anti-miR-106b. These results support the regulation of cell cycle progression by physiological levels of miR-16.

Analysis of the expression of cell cycle genes of anti-miR-16-treated TOV21G and HCT116 wild-type cells did not reveal any obvious differences from that of control-treated cells (data not shown). Thus, gene expression changes measured by microarray were not sufficient to identify a detectable cell cycle phenotype in these cells.

While not wishing to be bound by theory, it was hypothesized that cells having higher endogenous levels of miR-16 would be more susceptible to anti-miR-16-induced phenotypic changes detectable by flow cytometry. In order to determine endogenous miR-16 levels, a number of transfectable cell lines were screened using a quantitative primer extension PCR assay (Raymond, C. K. et al., RNA 11:1737-1744 (2005)). These screening experiments showed that the cell line SW1417 had elevated levels of endogenous miR-16 (~1,500 copies/cell) (data not shown). The transfection of SW1417 cells with anti-miR-16 resulted in a significant decrease in numbers of G0G1 compared to mock-transfected cells [10%±1% decrease (three independent experiments); P<1E-3. In contrast, anti-miR-106b-transfected cells did not show significant differences from mock-transfected cells [5%±3% decrease (three independent experiments); P>5E-2]. Therefore, these results indicate that disruption of physiological miR-16 levels in certain cell types can alter cell cycle distribution.

EXAMPLE 9

This example demonstrates that the levels of miR-16 family-down-regulated transcripts negatively correlate with miR-195 levels in human tumors.

Rationale: An experiment was carried out to determine whether gene expression changes triggered by miRNA transfection in the in vitro models described in EXAMPLES 1-7 reflect the relationship between steady state levels of transcripts down-regulated by miR-16 family members and miRNA levels in human tumors.

Methods:

RNA was isolated from a series of 29 tumors and 28 adjacent uninvolved normal tissues. mRNA expression was measured using microarrays, and miR-195 levels were determined using a quantitative primer extension PCR assay (Raymond, C. K. et al., RNA 11:1737-1744 (2005)). miR-195 (an miR-16 family member) was chosen for this due to the availability of reliable tumor atlas expression data.

mRNA and miRNA expression levels in human tumors (including breast cancer, lung cancer, colon cancer, kidney cancer and gastric cancer), and adjacent normal tissues were expressed as ratios of these levels to expression levels in a pool of normal samples from each tissue type. Correlations between expression level ratios for miR-195 and transcripts down-regulated 24 h after the transfection of tissue culture cells with miR-16 were calculated. As a control, correlations were also calculated for ~200 random permutations of expression ratios (random transcripts).

Figure 10:
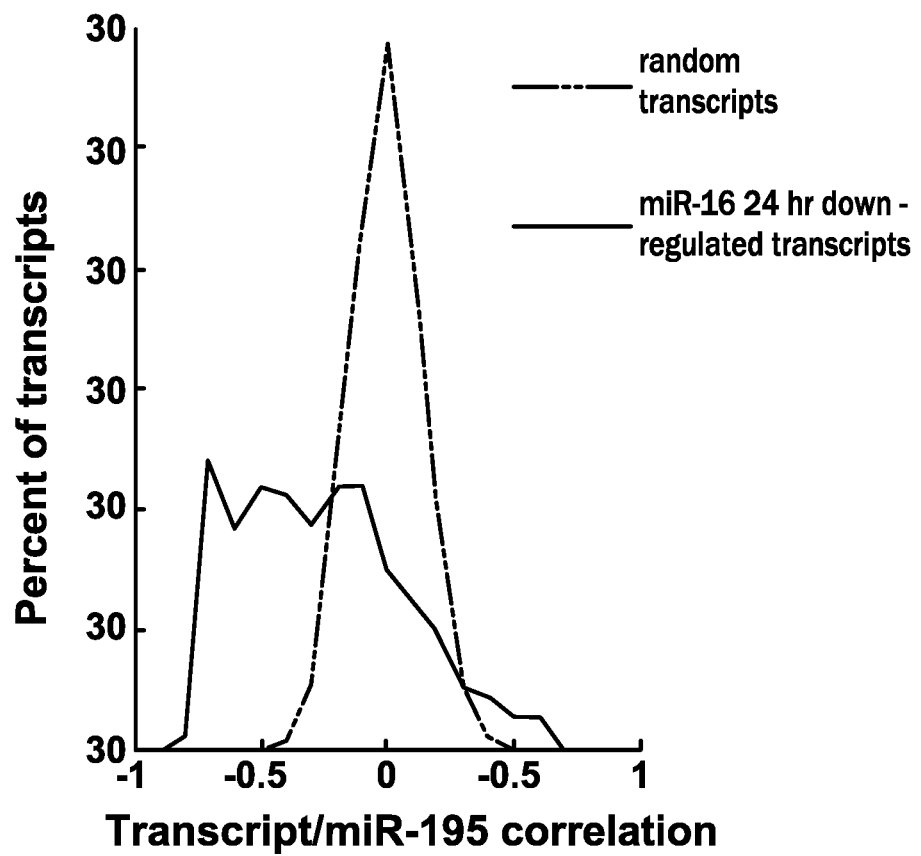
FIG. 10 graphically illustrates the negative correlation between expression level ratios for miR-195 and transcripts identified as downregulated 24 h after transfection of miR-16 as determined from RNA isolated from a series of 29 tumors and 28 adjacent normal tissues, as described in EXAMPLE 9.

Results:

FIG. 10 graphically illustrates the correlation between expression ratios of miR-195 levels and the percentage of either random transcripts or miR-16 down-regulated transcripts in a panel of human tumors (breast, gastric, kidney, colon and lung) and adjacent normal tissues. As shown in FIG. 10, a significant negative correlation was observed between miR-195 levels and the levels of transcripts down-regulated by miR-16 at 24 h post-transfection. miR-16-down-regulated transcripts were found to be significantly more likely to be negatively correlated with miR-195 levels than would be expected by change [P<1.5E-12; Wilcoxon rank-sum P value for a difference in median correlation coefficient versus random permutations of expression ratios]. Thus, tumors with high levels of miR-195 tended to have low levels of transcripts that were down-regulated by transfection with miR-16, and vice versa. These results demonstrate that gene expression changes triggered by miRNA transfection in the in vitro model described in EXAMPLES 1-7 do reflect the relationship between levels of the transcripts and the miRNA in human tumors.

While illustrative embodiments have been illustrated and described, it will be appreciated that various changes can be made therein without departing from the spirit and scope of the invention.

SEQUENCE LISTING (526 sequences)

SEQ ID NO: 1 - RNA, 22 nt, Homo sapiens
uagcagcacauaaugguuugug

SEQ ID NO: 2 - RNA, 22 nt, Homo sapiens
uagcagcacaucaugguuuaca

SEQ ID NO: 3 - RNA, 22 nt, Homo sapiens
uagcagcacguaaauauuggcg

SEQ ID NO: 4 - RNA, 23 nt, Homo sapiens
agcagcauuguacagggcuauga

SEQ ID NO: 5 - RNA, 23 nt, Homo sapiens
agcagcauuguacagggcuauca

SEQ ID NO: 6 - RNA, 21 nt, Homo sapiens
uagcagcacagaaauauuggc

SEQ ID NO: 7 - RNA, 22 nt, Homo sapiens
ccagcagcaccuaauccaucgg

SEQ ID NO: 8 - RNA, 8 nt, Homo sapiens
uagcagca

SEQ ID NO: 9 - RNA, 24 nt, Homo sapiens
caaagugcuuacagugcagguagu

SEQ ID NO: 10 - RNA, 23 nt, Homo sapiens
uaaagugcuuauagugcagguag

SEQ ID NO: 11 - RNA, 21 nt, Homo sapiens
uaaagugcugacagugcagau

SEQ ID NO: 12 - RNA, 22 nt, Homo sapiens
uaacacugucugguaaagaugg

SEQ ID NO: 13 - RNA, 22 nt, Homo sapiens
uaacacugucugguaacgaugu

SEQ ID NO: 14 - RNA, 21 nt, Homo sapiens
cugaccuaugaauugacagcc

SEQ ID NO: 15 - RNA, 21 nt, Homo sapiens
augaccuaugaauugacagac

SEQ ID NO: 16 - RNA, 23 nt, Homo sapiens
agcagcauuguacagggcuauga

SEQ ID NO: 17 - RNA, 23 nt, Homo sapiens
auagcccuguacaaugcugguau

SEQ ID NO: 18 - RNA, 21 nt, Homo sapiens
uaaagugcugacagugcagau

SEQ ID NO: 19 - RNA, 21 nt, Homo sapiens
cugcacugucagcacuuuaau

SEQ ID NO: 20 - RNA, 22 nt, Homo sapiens
uugguccccuucaaccagcugu

SEQ ID NO: 21 - RNA, 22 nt, Homo sapiens
agcugguugaaggggauuaaau

SEQ ID NO: 22 - RNA, 21 nt, Homo sapiens
aacacugucugguaaagaugg

SEQ ID NO: 23 - RNA, 21 nt, Homo sapiens
aucuuuaccagacagugauau

SEQ ID NO: 24 - RNA, 24 nt, Homo sapiens
guccaguuuucccaggaaucccuu

SEQ ID NO: 25 - RNA, 24 nt, Homo sapiens
gggauuccugggaaaacuggucau

SEQ ID NO: 26 - RNA, 22 nt, Homo sapiens
uuaaugcuaaucgugauagggg

SEQ ID NO: 27 - RNA, 22 nt, Homo sapiens
ccuaucacgauuagcauuaaau

SEQ ID NO: 28 - RNA, 22 nt, Homo sapiens
uagcagcacauaaugguuugug

SEQ ID NO: 29 - RNA, 22 nt, Homo sapiens
caaaccauuaugugcugcaaau

SEQ ID NO: 30 - RNA, 22 nt, Homo sapiens
uagcagcacguaaauauuggcg

SEQ ID NO: 31 - RNA, 22 nt, Homo sapiens
ccaauauuuacgugcugcaaau

SEQ ID NO: 32 - RNA, 20 nt, Homo sapiens
acugcagugaaggcacuugu

SEQ ID NO: 33 - RNA, 20 nt, Homo sapiens
aagugccuucacugcacuau

SEQ ID NO: 34 - RNA, 24 nt, Homo sapiens
caaagugcuuacagugcagguagu

SEQ ID NO: 35 - RNA, 24 nt, Homo sapiens
uaccugcacuguaagcacuuagau

SEQ ID NO: 36 - RNA, 22 nt, Homo sapiens
uaaggugcaucuagugcagaua

SEQ ID NO: 37 - RNA, 22 nt, Homo sapiens
ucugcacuagaugcacuuuaau

SEQ ID NO: 38 - RNA, 21 nt, Homo sapiens
cugaccuaugaauugacagcc

SEQ ID NO: 39 - RNA, 21 nt, Homo sapiens
cugucaauucauaggucugau

SEQ ID NO: 40 - RNA, 22 nt, Homo sapiens
uguaacagcaacuccaugugga

SEQ ID NO: 41 - RNA, 22 nt, Homo sapiens
cacauggaguugcuguuagaau

SEQ ID NO: 42 - RNA, 23 nt, Homo sapiens
ugugcaaaucuaugcaaaacuga

SEQ ID NO: 43 - RNA, 23 nt, Homo sapiens
aguuuugcauagauuugcagaau

SEQ ID NO: 44 - RNA, 23 nt, Homo sapiens
ugugcaaauccaugcaaaacuga

SEQ ID NO: 45 - RNA, 23 nt, Homo sapiens
aguuuugcauggauuugcagaau

SEQ ID NO: 46 - RNA, 22 nt, Homo sapiens
uaacacugucugguaacgaugu

SEQ ID NO: 47 - RNA, 22 nt, Homo sapiens
aucguuaccagacaguguaaau

SEQ ID NO: 48 - RNA, 24 nt, Homo sapiens
cucuaauacugccugguaaugaug

SEQ ID NO: 49 - RNA, 24 nt, Homo sapiens
ucauuaccaggcaguauuagugau

SEQ ID NO: 50 - RNA, 22 nt, Homo sapiens
uaaagugcuuauagugcaggua

SEQ ID NO: 51 - RNA, 22 nt, Homo sapiens
ccugcacuauaagcacuuuaau

SEQ ID NO: 52 - RNA, 22 nt, Homo sapiens
uagcuuaucagacugauguuga

SEQ ID NO: 53 - RNA, 22 nt, Homo sapiens
aacaucagucugauaagcaaau

SEQ ID NO: 54 - RNA, 21 nt, Homo sapiens
augaccuaugaauugacagac

SEQ ID NO: 55 - RNA, 21 nt, Homo sapiens
cugucaauucauaggucuuau

SEQ ID NO: 56 - RNA, 23 nt, Homo sapiens
agcuacauugucugcuggguuuc

SEQ ID NO: 57 - RNA, 23 nt, Homo sapiens
aacccagcagacaauguagguau

SEQ ID NO: 58 - RNA, 22 nt, Homo sapiens
cauugcacuugucucggucuga

SEQ ID NO: 59 - RNA, 22 nt, Homo sapiens
agaccgagacaagugcaaagau

SEQ ID NO: 60 - RNA, 22 nt, Homo sapiens
uauugcacuugucccggccugu

SEQ ID NO: 61 - RNA, 22 nt, Homo sapiens
aggccgggacaagugcaauaau

SEQ ID NO: 62 - RNA, 22 nt, Homo sapiens
aaagugcuguucgugcagguag

SEQ ID NO: 63 - RNA, 22 nt, Homo sapiens
accugcacgaacagcacuuuau

SEQ ID NO: 64 - RNA, 22 nt, Homo sapiens
ccagcagcaccuaauccaucgg

SEQ ID NO: 65 - RNA, 22 nt, Homo sapiens
gauggauuaggugcugcucgau

SEQ ID NO: 66 - RNA, 22 nt, Homo sapiens
ucacauucugaggacggcagcg

SEQ ID NO: 67 - RNA, 22 nt, Homo sapiens
cugccguccucagaaugucaau

SEQ ID NO: 68 - RNA, 22 nt, Homo sapiens
uaaaccaugaugugcugcaaau

SEQ ID NO: 69 - RNA, 21 nt, Homo sapiens
caauauuucugugcugcaaau

SEQ ID NO: 70 - RNA, 23 nt, Homo sapiens
auagcccuguacaaugcugguau

SEQ ID NO: 71 - RNA, 22 nt, Homo sapiens
ccauacaaccuacuacuuuaau

SEQ ID NO: 72 - RNA, 22 nt, Homo sapiens
ccugcacuauaagcacuuuaau

SEQ ID NO: 73 - RNA, 20 nt, Homo sapiens
ggaggaagggcccagacgau

SEQ ID NO: 74 - RNA, 21 nt, Homo sapiens
gggacuuuguaggccaguuau

SEQ ID NO: 75 - RNA, 21 nt, Homo sapiens
gccugucugugccuguuguau

SEQ ID NO: 76 - RNA, 22 nt, Homo sapiens
caauagacugugagcuccauau

SEQ ID NO: 77 - RNA, 22 nt, Homo sapiens
gcauucaccgcgugccuuaaau

SEQ ID NO: 78 - RNA, 22 nt, Homo sapiens
guuccugcugaacugagcgaau

SEQ ID NO: 79 - RNA, 22 nt, Homo sapiens
guaugugggacgguaaacgaau

SEQ ID NO: 80 - RNA, 23 nt, Homo sapiens
aggcaggcaugcgggcagauaau

SEQ ID NO: 81 - RNA, 22 nt, Homo sapiens
ccaaugugcagacuacugaaau

SEQ ID NO: 82 - RNA, 21 nt, Homo sapiens
gccgcugucacacgcauagau

SEQ ID NO: 83 - RNA, 21 nt, Homo sapiens
cucuggucaaccagucagaau

SEQ ID NO: 84 - RNA, 22 nt, Homo sapiens
acacacuuccuuacauuuuaau

SEQ ID NO: 85 - RNA, 22 nt, Homo sapiens
aguucuucaacuggcagcauau

SEQ ID NO: 86 - RNA, 23 nt, Homo sapiens
cgcccucucaacccagcuuuuau

SEQ ID NO: 87 - RNA, 21 nt, Homo sapiens
caguugccagcugagauaaau

SEQ ID NO: 88 - RNA, 23 nt, Homo sapiens
aggcaucauauaggagcugcaau

SEQ ID NO: 89 - RNA, 22 nt, Homo sapiens
acaaguuagggucucaggcaau

SEQ ID NO: 90 - RNA, 22 nt, Homo sapiens
aucagcuaacuacacugcguau

SEQ ID NO: 91 - RNA, 21 nt, Homo sapiens
cuaggauaggcccagggccau

SEQ ID NO: 92 - RNA, 22 nt, Homo sapiens
aucagcuaaugacacugcguau

SEQ ID NO: 93 - RNA, 21 nt, Homo sapiens
acucaaaagauggcggcucau

SEQ ID NO: 94 - RNA, 22 nt, Homo sapiens
acgcguauucuuaagcaauaau

SEQ ID NO: 95 - RNA, 22 nt, Homo sapiens
agcuacagugcuucauuuuaau

SEQ ID NO: 96 - RNA, 21 nt, Homo sapiens
ccuggacuaggagucaggaau

SEQ ID NO: 97 - RNA, 22 nt, Homo sapiens
acgcgagccgaacgaacaaaau

SEQ ID NO: 98 - RNA, 21 nt, Homo sapiens
aacaacaggaaacuaccaaau

SEQ ID NO: 99 - RNA, 20 nt, Homo sapiens
agaagcauuuccacacucau

SEQ ID NO: 100 - RNA, 21 nt, Homo sapiens
caaaaucacuagucuucgaau

SEQ ID NO: 101 - RNA, 23 nt, Homo sapiens
gugaauucuaccagugcuauaau

SEQ ID NO: 102 - RNA, 21 nt, Homo sapiens
cauacuucuuuacauucgaau

SEQ ID NO: 103 - RNA, 21 nt, Homo sapiens
aacaacaugaaacuaccaaau

SEQ ID NO: 104 - RNA, 23 nt, Homo sapiens
ugauaucagcucaguaggcucau

SEQ ID NO: 105 - RNA, 22 nt, Homo sapiens
aaccagcuaagacacugcgaau

SEQ ID NO: 106 - RNA, 22 nt, Homo sapiens
uggguggagaaggugguguaau

SEQ ID NO: 107 - RNA, 23 nt, Homo sapiens
gguaaucccuggcaauguguuau

SEQ ID NO: 108 - RNA, 21 nt, Homo sapiens
agcuccuggaggacaggcaau

SEQ ID NO: 109 - RNA, 22 nt, Homo sapiens
aaaguucuguagugcacucaau

SEQ ID NO: 110 - RNA, 21 nt, Homo sapiens
accauaggguaaaacuauuau

SEQ ID NO: 111 - RNA, 19 nt, Homo sapiens
augcaacuacaaugcucau

SEQ ID NO: 112 - RNA, 22 nt, Homo sapiens
cuauacaaucuacuaccugaau

SEQ ID NO: 113 - RNA, 22 nt, Homo sapiens
agugaagacacggagccacaau

SEQ ID NO: 114 - RNA, 22 nt, Homo sapiens
aaaguucugugaugcacucaau

SEQ ID NO: 115 - RNA, 22 nt, Homo sapiens
gacuccgguggaaugaagcaau

SEQ ID NO: 116 - RNA, 23 nt, Homo sapiens
ucugcaggccgugugcuuuccau

SEQ ID NO: 117 - RNA, 21 nt, Homo sapiens
uuacuggacaccuacuacgau

SEQ ID NO: 118 - RNA, 22 nt, Homo sapiens
cauaggaaugaaaagccaaaau

SEQ ID NO: 119 - RNA, 22 nt, Homo sapiens
cuauacaaccuacuaccugaau

SEQ ID NO: 120 - RNA, 22 nt, Homo sapiens
aagcuuuuugcucgucuuuuau

SEQ ID NO: 121 - RNA, 23 nt, Homo sapiens
cauaaaguaggaaacacuagaau

SEQ ID NO: 122 - RNA, 21 nt, Homo sapiens
agguuccaccccagcagccau

SEQ ID NO: 123 - RNA, 24 nt, Homo sapiens
ccaaucaguuccugaugcagaaau

SEQ ID NO: 124 - RNA, 22 nt, Homo sapiens
ucaguuaucacaguacugaaau

SEQ ID NO: 125 - RNA, 23 nt, Homo sapiens
aaacaccauugucacacucgaau

SEQ ID NO: 126 - RNA, 23 nt, Homo sapiens
acauaggaauaaaaagccaaaau

SEQ ID NO: 127 - RNA, 22 nt, Homo sapiens
ggaagggcagagagggccugau

SEQ ID NO: 128 - RNA, 22 nt, Homo sapiens
agcagcaccuggggcagucgau

SEQ ID NO: 129 - RNA, 21 nt, Homo sapiens
gcugguugaaggggauuaaau

SEQ ID NO: 130 - RNA, 22 nt, Homo sapiens
agugguccuaaacauuucucau

SEQ ID NO: 131 - RNA, 22 nt, Homo sapiens
acguggaauuuccucuaucuau

SEQ ID NO: 132 - RNA, 21 nt, Homo sapiens
uguacaaacuacuaccugaau

SEQ ID NO: 133 - RNA, 20 nt, Homo sapiens
acuuuugugacuaugcuaau

SEQ ID NO: 134 - RNA, 22 nt, Homo sapiens
aaaaaugugcuagugccauaau

SEQ ID NO: 135 - RNA, 22 nt, Homo sapiens
aguacaucaucuauacugaaau

SEQ ID NO: 136 - RNA, 22 nt, Homo sapiens
ccaagcucagacggaucccaau

SEQ ID NO: 137 - RNA, 22 nt, Homo sapiens
cuaauauaucaaacauaugaau

SEQ ID NO: 138 - RNA, 22 nt, Homo sapiens
cucaauaaauacccguuguaau

SEQ ID NO: 139 - RNA, 22 nt, Homo sapiens
ccacacaaccuacuacuuuaau

SEQ ID NO: 140 - RNA, 21 nt, Homo sapiens
auuauuacucacgguaccaau

SEQ ID NO: 141 - RNA, 23 nt, Homo sapiens
caaauucggaucuacagggaaau

SEQ ID NO: 142 - RNA, 22 nt, Homo sapiens
accgauuucaaaugguguuaau

SEQ ID NO: 143 - RNA, 21 nt, Homo sapiens
ugccccuaaaaauccuuauau

SEQ ID NO: 144 - RNA, 19 nt, Homo sapiens
cacaaacuacuaccugaau

SEQ ID NO: 145 - RNA, 20 nt, Homo sapiens
aggagucugagcauuucaau

SEQ ID NO: 146 - RNA, 22 nt, Homo sapiens
ccgauuucagaugguguuagau

SEQ ID NO: 147 - RNA, 20 nt, Homo sapiens
gaacuuagccacuguguaau

SEQ ID NO: 148 - RNA, 22 nt, Homo sapiens
aagagaccgguucacugucaau

SEQ ID NO: 149 - RNA, 21 nt, Homo sapiens
uuucgguuaucuagcuuaaau

SEQ ID NO: 150 - RNA, 21 nt, Homo sapiens
uauacaaccuccuaccugaau

SEQ ID NO: 151 - RNA, 21 nt, Homo sapiens
aaaucccuggcaauguguuau

SEQ ID NO: 152 - RNA, 22 nt, Homo sapiens
cugcuuuugggauuccguagau

SEQ ID NO: 153 - RNA, 21 nt, Homo sapiens
uaugcaaccuacuaccuguau

SEQ ID NO: 154 - RNA, 23 nt, Homo sapiens
auacagcuagauaaccaaacaau

SEQ ID NO: 155 - RNA, 22 nt, Homo sapiens
uacaaucaacggucgaugcuau

SEQ ID NO: 156 - RNA, 21 nt, Homo sapiens
gcuaugccagcaucuuggcau

SEQ ID NO: 157 - RNA, 21 nt, Homo sapiens
augguuagaucaagcacuaau

SEQ ID NO: 158 - RNA, 22 nt, Homo sapiens
caauacaacuuacuaccugaau

SEQ ID NO: 159 - RNA, 21 nt, Homo sapiens
ccgugacuggagacuguuaau

SEQ ID NO: 160 - RNA, 21 nt, Homo sapiens
cuauccugaauuacuuguaau

SEQ ID NO: 161 - RNA, 22 nt, Homo sapiens
gcgaaggaugacaaaggguaau

SEQ ID NO: 162 - RNA, 22 nt, Homo sapiens
caaguucggaucuacgggauau

SEQ ID NO: 163 - RNA, 22 nt, Homo sapiens
ccuauccuggauuacuuguaau

SEQ ID NO: 164 - RNA, 23 nt, Homo sapiens
aguuuugcauagauuugcagaau

SEQ ID NO: 165 - RNA, 23 nt, Homo sapiens
acugaaacauggaagcauuuaau

SEQ ID NO: 166 - RNA, 21 nt, Homo sapiens
gguauuugacaaacugagaau

SEQ ID NO: 167 - RNA, 23 nt, Homo sapiens
acagguagucugaacacugcgau

SEQ ID NO: 168 - RNA, 22 nt, Homo sapiens
aggucgaccguguaauguccau

SEQ ID NO: 169 - RNA, 21 nt, Homo sapiens
agugucagauacggugucgau

SEQ ID NO: 170 - RNA, 23 nt, Homo sapiens
accaaaacauggaagcacuuaau

SEQ ID NO: 171 - RNA, 22 nt, Homo sapiens
accauggcuguagacuguaaau

SEQ ID NO: 172 - RNA, 22 nt, Homo sapiens
ucaaggagcuucagucuacuau

SEQ ID NO: 173 - RNA, 24 nt, Homo sapiens
gacccaguagccagauguagguau

SEQ ID NO: 174 - RNA, 22 nt, Homo sapiens
caucauuacccggcaguaauau

SEQ ID NO: 175 - RNA, 22 nt, Homo sapiens
caaggucgguucuacgggagau

SEQ ID NO: 176 - RNA, 21 nt, Homo sapiens
guuggcaagucuagaacgaau

SEQ ID NO: 177 - RNA, 22 nt, Homo sapiens
ccuuaucaguucuccguuuaau

SEQ ID NO: 178 - RNA, 22 nt, Homo sapiens
aaauucgguucuacagggaaau

SEQ ID NO: 179 - RNA, 24 nt, Homo sapiens
uaccugcacuguaagcacuuuuau

SEQ ID NO: 180 - RNA, 21 nt, Homo sapiens
aacuuaguaaugugcaaaaau

SEQ ID NO: 181 - RNA, 22 nt, Homo sapiens
aagagaccgguucacugucaau

SEQ ID NO: 182 - RNA, 22 nt, Homo sapiens
cuuaucagguuguauuauuaau

SEQ ID NO: 183 - RNA, 22 nt, Homo sapiens
uaggucaaccguguaugaauau

SEQ ID NO: 184 - RNA, 23 nt, Homo sapiens
acagauagucuaaacacugcgau

SEQ ID NO: 185 - RNA, 22 nt, Homo sapiens
aaagcgcccccauuuugacuau

SEQ ID NO: 186 - RNA, 22 nt, Homo sapiens
gcauaggaugacaaaggguaau

SEQ ID NO: 187 - RNA, 20 nt, Homo sapiens
ugauuucaaauggugcaaau

SEQ ID NO: 188 - RNA, 23 nt, Homo sapiens
aacaaaaucacugaugcugcaau

SEQ ID NO: 189 - RNA, 23 nt, Homo sapiens
accaaugcccuaggggaugggau

SEQ ID NO: 190 - RNA, 22 nt, Homo sapiens
ugaguucuaccauugcuaaaau

SEQ ID NO: 191 - RNA, 21 nt, Homo sapiens
agaucaaccauguauuaauau

SEQ ID NO: 192 - RNA, 21 nt, Homo sapiens
aaguucugucaugcacucaau

SEQ ID NO: 193 - RNA, 23 nt, Homo sapiens
acuaaaacauggaagcacuaaau

SEQ ID NO: 194 - RNA, 22 nt, Homo sapiens
ucaccgacagguugaaugauau

SEQ ID NO: 195 - RNA, 21 nt, Homo sapiens
aagcccagaccgcaaaaugau

SEQ ID NO: 196 - RNA, 22 nt, Homo sapiens
uccagucggggauguuuauaau

SEQ ID NO: 197 - RNA, 17 nt, Homo sapiens
uucacaacaccagguau

SEQ ID NO: 198 - RNA, 23 nt, Homo sapiens
auuuuucguuauugcucuucaau

SEQ ID NO: 199 - RNA, 22 nt, Homo sapiens
cccauggaauucaguuuuuaau

SEQ ID NO: 200 - RNA, 19 nt, Homo sapiens
uaucuccccucuggagcau

SEQ ID NO: 201 - RNA, 22 nt, Homo sapiens
cggaacuuagccacuguguaau

SEQ ID NO: 202 - RNA, 20 nt, Homo sapiens
ccuuuuaacauugcacagau

SEQ ID NO: 203 - RNA, 23 nt, Homo sapiens
aacggaaccacuagugacuagau

SEQ ID NO: 204 - RNA, 23 nt, Homo sapiens
ucaccgacagcguugaaugauau

SEQ ID NO: 205 - RNA, 23 nt, Homo sapiens
gcccaaaaggagaauucuuugau

SEQ ID NO: 206 - RNA, 22 nt, Homo sapiens
accauugcuaaagugcaauuau

SEQ ID NO: 207 - RNA, 24 nt, Homo sapiens
cccaccgacagcaaugaauguuau

SEQ ID NO: 208 - RNA, 21 nt, Homo sapiens
cguaccaaaaguaauaaagau

SEQ ID NO: 209 - RNA, 23 nt, Homo sapiens
ugagaguguaggauguuuagaau

SEQ ID NO: 210 - RNA, 22 nt, Homo sapiens
ugcaaacauccgacugaaagau

SEQ ID NO: 211 - RNA, 22 nt, Homo sapiens
gcccuuucaucauugcacugau

SEQ ID NO: 212 - RNA, 22 nt, Homo sapiens
ccuccaccaugcaagggaagau

SEQ ID NO: 213 - RNA, 18 nt, Homo sapiens
acugccuuucucuuuaau

SEQ ID NO: 214 - RNA, 21 nt, Homo sapiens
aggauugaggggggguuuuau

SEQ ID NO: 215 - RNA, 22 nt, Homo sapiens
cugguacaaggguugggacaau

SEQ ID NO: 216 - RNA, 23 nt, Homo sapiens
acucaaacauggaagcauuuaau

SEQ ID NO: 217 - RNA, 22 nt, Homo sapiens
agcaaguacauccacguuuaau

SEQ ID NO: 218 - RNA, 21 nt, Homo sapiens
aauugcguuuggacaaugaau

SEQ ID NO: 219 - RNA, 22 nt, Homo sapiens
aaggcaacacggauaauuuaau

SEQ ID NO: 220 - RNA, 21 nt, Homo sapiens
gcugcaacacaagacaccaau

SEQ ID NO: 221 - RNA, 23 nt, Homo sapiens
accccaaaaucgaagcacuucau

SEQ ID NO: 222 - RNA, 23 nt, Homo sapiens
uuccagucgaggauguuuagaau

SEQ ID NO: 223 - RNA, 23 nt, Homo sapiens
cuauaaaguaacugagacgcaau

SEQ ID NO: 224 - RNA, 23 nt, Homo sapiens
caucaucaaaacaaauggacuau

SEQ ID NO: 225 - RNA, 22 nt, Homo sapiens
gcagguacccccauguuaaaau

SEQ ID NO: 226 - RNA, 20 nt, Homo sapiens
agugcuuucuacuuuaagau

SEQ ID NO: 227 - RNA, 24 nt, Homo sapiens
cgggugcgauuucugugugacaau

SEQ ID NO: 228 - RNA, 23 nt, Homo sapiens
cagguuaaagggucucaggcaau

SEQ ID NO: 229 - RNA, 18 nt, Homo sapiens
acacgugcacuguacaau

SEQ ID NO: 230 - RNA, 23 nt, Homo sapiens
aaagcacuuccauguuaaacuau

SEQ ID NO: 231 - RNA, 21 nt, Homo sapiens
ugaguguaggauguuuagaau

SEQ ID NO: 232 - RNA, 20 nt, Homo sapiens
cagucaaggauguuuagaau

SEQ ID NO: 233 - RNA, 22 nt, Homo sapiens
caagaucggaucuacgggauau

SEQ ID NO: 234 - RNA, 23 nt, Homo sapiens
uuugacaauacuauugcacagau

SEQ ID NO: 235 - RNA, 23 nt, Homo sapiens
gcucaaaugucgcagcacuuuau

SEQ ID NO: 236 - DNA, 21 bp, Artificial Sequence
  Synthetic
  misc_feature (20)..(21): Sequence is RNA/DNA hybrid, wherein N = T
cagaagaauggcuucacaunn

SEQ ID NO: 237 - DNA, 21 bp, Artificial Sequence
  Synthetic
  misc_feature (20)..(21): Sequence is RNA/DNA hybrid, wherein N = T
augugaagccauucuucugnn

SEQ ID NO: 238 - DNA, 21 bp, Artificial Sequence
  Synthetic
  misc_feature (20)..(21): Sequence is RNA/DNA hybrid, wherein N = T
gcuuaucaaguucaucuaunn

SEQ ID NO: 239 - DNA, 21 bp, Artificial Sequence
  Synthetic
  misc_feature (20)..(21): Sequence is RNA/DNA hybrid, wherein N = T
auagaugaacuugauaagcnn

SEQ ID NO: 240 - DNA, 21 bp, Artificial Sequence
  Synthetic
  misc_feature (20)..(21): Sequence is RNA/DNA hybrid, wherein N = T
gcuacaagcccgccuccaann

SEQ ID NO: 241 - DNA, 21 bp, Artificial Sequence
  Synthetic
  misc_feature (20)..(21): Sequence is RNA/DNA hybrid, wherein N = T
uuggaggcgggcuuguagcnn

SEQ ID NO: 242 - DNA, 21 bp, Artificial Sequence
  Synthetic
  misc_feature (20)..(21): Sequence is RNA/DNA hybrid, wherein N = T
gucgagagcucccuggauann

SEQ ID NO: 243 - DNA, 21 bp, Artificial Sequence
  Synthetic
  misc_feature (20)..(21): Sequence is RNA/DNA hybrid, wherein N = T
uauccagggagcucucgacnn

SEQ ID NO: 244 - DNA, 21 bp, Artificial Sequence
  Synthetic
  misc_feature (20)..(21): Sequence is RNA/DNA hybrid, wherein N = T
gucugugugcagaaucuuann

SEQ ID NO: 245 - DNA, 21 bp, Artificial Sequence
  Synthetic
  misc_feature (20)..(21): Sequence is RNA/DNA hybrid, wherein N = T
uaagauucugcacacagacnn

SEQ ID NO: 246 - DNA, 21 bp, Artificial Sequence
  Synthetic
  misc_feature (20)..(21): Sequence is RNA/DNA hybrid, wherein N = T
gacucagaccuggacauaunn

SEQ ID NO: 247 - DNA, 21 bp, Artificial Sequence
  Synthetic
  misc_feature (20)..(21): Sequence is RNA/DNA hybrid, wherein N = T
auauguccaggucugagucnn

SEQ ID NO: 248 - DNA, 21 bp, Artificial Sequence
  Synthetic
  misc_feature (20)..(21): Sequence is RNA/DNA hybrid, wherein N = T
cagauguauagugaucugann

SEQ ID NO: 249 - DNA, 21 bp, Artificial Sequence
  Synthetic
  misc_feature (20)..(21): Sequence is RNA/DNA hybrid, wherein N = T
ucagaucacuauacaucugnn

SEQ ID NO: 250 - DNA, 21 bp, Artificial Sequence
  Synthetic
  misc_feature (20)..(21): Sequence is RNA/DNA hybrid, wherein N = T
gacaauauaugggagcauunn

SEQ ID NO: 251 - DNA, 21 bp, Artificial Sequence
  Synthetic
  misc_feature (20)..(21): Sequence is RNA/DNA hybrid, wherein N = T
aaugcucccauauauugucnn

SEQ ID NO: 252 - DNA, 21 bp, Artificial Sequence
  Synthetic
  misc_feature (20)..(21): Sequence is RNA/DNA hybrid, wherein N = T
gcuguuuacggaacauguunn

SEQ ID NO: 253 - DNA, 21 bp, Artificial Sequence
  Synthetic
  misc_feature (20)..(21): Sequence is RNA/DNA hybrid, wherein N = T
aacauguuccguaaacagcnn

SEQ ID NO: 254 - DNA, 21 bp, Artificial Sequence
  Synthetic
  misc_feature (20)..(21): Sequence is RNA/DNA hybrid, wherein N = T
gcuaugugccuuccuaauunn

SEQ ID NO: 255 - DNA, 21 bp, Artificial Sequence
  Synthetic
  misc_feature (20)..(21): Sequence is RNA/DNA hybrid, wherein N = T
aauuaggaaggcacauagcnn

SEQ ID NO: 256 - DNA, 21 bp, Artificial Sequence
  Synthetic
  misc_feature (20)..(21): Sequence is RNA/DNA hybrid, wherein N = T
cacuuugccuugaagaguunn

SEQ ID NO: 257 - DNA, 21 bp, Artificial Sequence
  Synthetic
  misc_feature (20)..(21): Sequence is RNA/DNA hybrid, wherein N = T
aacucuucaaggcaaagugnn

SEQ ID NO: 258 - DNA, 21 bp, Artificial Sequence
  Synthetic
  misc_feature (20)..(21): Sequence is RNA/DNA hybrid, wherein N = T
gcugaaugauagagauauunn

SEQ ID NO: 259 - DNA, 21 bp, Artificial Sequence
  Synthetic
  misc_feature (20)..(21): Sequence is RNA/DNA hybrid, wherein N = T
aauaucucuaucauucagcnn

SEQ ID NO: 260 - DNA, 21 bp, Artificial Sequence
  Synthetic
  misc_feature (20)..(21): Sequence is RNA/DNA hybrid, wherein N = T
cucauccugagacuuucuunn

SEQ ID NO: 261 - DNA, 21 bp, Artificial Sequence
  Synthetic
  misc_feature (20)..(21): Sequence is RNA/DNA hybrid, wherein N = T
aagaaagucucaggaugagnn

SEQ ID NO: 262 - DNA, 21 bp, Artificial Sequence
  Synthetic
  misc_feature (20)..(21): Sequence is RNA/DNA hybrid, wherein N = T
ggauugccuccaagcccuann

SEQ ID NO: 263 - DNA, 21 bp, Artificial Sequence
  Synthetic
  misc_feature (20)..(21): Sequence is RNA/DNA hybrid, wherein N = T
uagggcuuggaggcaauccnn

SEQ ID NO: 264 - DNA, 21 bp, Artificial Sequence
  Synthetic
  misc_feature (20)..(21): Sequence is RNA/DNA hybrid, wherein N = T
gcuuucuucugacguugcann

SEQ ID NO: 265 - DNA, 21 bp, Artificial Sequence
  Synthetic
  misc_feature (20)..(21): Sequence is RNA/DNA hybrid, wherein N = T
ugcaacgucagaagaaagcnn

SEQ ID NO: 266 - DNA, 21 bp, Artificial Sequence
  Synthetic
  misc_feature (20)..(21): Sequence is RNA/DNA hybrid, wherein N = T
caguguuuggcggcuacuann

SEQ ID NO: 267 - DNA, 21 bp, Artificial Sequence
  Synthetic
  misc_feature (20)..(21): Sequence is RNA/DNA hybrid, wherein N = T
uaguagccgccaaacacugnn

SEQ ID NO: 268 - DNA, 21 bp, Artificial Sequence
  Synthetic
  misc_feature (20)..(21): Sequence is RNA/DNA hybrid, wherein N = T
gugugauucagcuuugguunn

SEQ ID NO: 269 - DNA, 21 bp, Artificial Sequence
  Synthetic
  misc_feature (20)..(21): Sequence is RNA/DNA hybrid, wherein N = T
aaccaaagcugaaucacacnn

SEQ ID NO: 270 - DNA, 21 bp, Artificial Sequence
  Synthetic
  misc_feature (20)..(21): Sequence is RNA/DNA hybrid, wherein N = T
ggccuaugcggcuggccuunn

SEQ ID NO: 271 - DNA, 21 bp, Artificial Sequence
  Synthetic
  misc_feature (20)..(21): Sequence is RNA/DNA hybrid, wherein N = T
aaggccagccgcauaggccnn

SEQ ID NO: 272 - DNA, 21 bp, Artificial Sequence
  Synthetic
  misc_feature (20)..(21): Sequence is RNA/DNA hybrid, wherein N = T
gacaucacagggagugugann

SEQ ID NO: 273 - DNA, 21 bp, Artificial Sequence
  Synthetic
  misc_feature (20)..(21): Sequence is RNA/DNA hybrid, wherein N = T
ucacacucccugugaugucnn

SEQ ID NO: 274 - DNA, 21 bp, Artificial Sequence
  Synthetic
  misc_feature (20)..(21): Sequence is RNA/DNA hybrid, wherein N = T
guucucaugggcaggcucann

SEQ ID NO: 275 - DNA, 21 bp, Artificial Sequence
  Synthetic
  misc_feature (20)..(21): Sequence is RNA/DNA hybrid, wherein N = T
ugagccugcccaugagaacnn

SEQ ID NO: 276 - DNA, 21 bp, Artificial Sequence
  Synthetic
  misc_feature (20)..(21): Sequence is RNA/DNA hybrid, wherein N = T
caguuuggugcggccgcuann

SEQ ID NO: 277 - DNA, 21 bp, Artificial Sequence
  Synthetic
  misc_feature (20)..(21): Sequence is RNA/DNA hybrid, wherein N = T
uagcggccgcaccaaacugnn

SEQ ID NO: 278 - DNA, 21 bp, Artificial Sequence
  Synthetic
  misc_feature (20)..(21): Sequence is RNA/DNA hybrid, wherein N = T
cgucugauuucucggugcunn

SEQ ID NO: 279 - DNA, 21 bp, Artificial Sequence
  Synthetic
  misc_feature (20)..(21): Sequence is RNA/DNA hybrid, wherein N = T
agcaccgagaaaucagacgnn

SEQ ID NO: 280 - DNA, 21 bp, Artificial Sequence
  Synthetic
  misc_feature (20)..(21): Sequence is RNA/DNA hybrid, wherein N = T
cauugcagccuucgaacaann

SEQ ID NO: 281 - DNA, 21 bp, Artificial Sequence
  Synthetic
  misc_feature (20)..(21): Sequence is RNA/DNA hybrid, wherein N = T
uuguucgaaggcugcaaugnn

SEQ ID NO: 282 - DNA, 21 bp, Artificial Sequence
  Synthetic
  misc_feature (20)..(21): Sequence is RNA/DNA hybrid, wherein N = T
ccaauguggucgucaccgann

SEQ ID NO: 283 - DNA, 21 bp, Artificial Sequence
  Synthetic
  misc_feature (20)..(21): Sequence is RNA/DNA hybrid, wherein N = T
ucggugacgaccacauuggnn

SEQ ID NO: 284 - DNA, 21 bp, Artificial Sequence
  Synthetic
  misc_feature (20)..(21): Sequence is RNA/DNA hybrid, wherein N = T
gauaucaacccucaaaguunn

SEQ ID NO: 285 - DNA, 21 bp, Artificial Sequence
  Synthetic
  misc_feature (20)..(21): Sequence is RNA/DNA hybrid, wherein N = T
aacuuugaggguugauaucnn

SEQ ID NO: 286 - DNA, 21 bp, Artificial Sequence
  Synthetic
  misc_feature (20)..(21): Sequence is RNA/DNA hybrid, wherein N = T
ccaaagaaucccucguuuann

SEQ ID NO: 287 - DNA, 21 bp, Artificial Sequence
  Synthetic
  misc_feature (20)..(21): Sequence is RNA/DNA hybrid, wherein N = T
uaaacgagggauucuuuggnn

SEQ ID NO: 288 - DNA, 21 bp, Artificial Sequence
  Synthetic
  misc_feature (20)..(21): Sequence is RNA/DNA hybrid, wherein N = T
ccucuaugcaaauuucacann

SEQ ID NO: 289 - DNA, 21 bp, Artificial Sequence
  Synthetic
  misc_feature (20)..(21): Sequence is RNA/DNA hybrid, wherein N = T
ugugaaauuugcauagaggnn

SEQ ID NO: 290 - DNA, 21 bp, Artificial Sequence
  Synthetic
  misc_feature (20)..(21): Sequence is RNA/DNA hybrid, wherein N = T
guuggcaggugacuuuguann

SEQ ID NO: 291 - DNA, 21 bp, Artificial Sequence
  Synthetic
  misc_feature (20)..(21): Sequence is RNA/DNA hybrid, wherein N = T
uacaaagucaccugccaacnn

SEQ ID NO: 292 - DNA, 21 bp, Artificial Sequence
  Synthetic
  misc_feature (20)..(21): Sequence is RNA/DNA hybrid, wherein N = T
cccaagaagcaguguggaann

SEQ ID NO: 293 - DNA, 21 bp, Artificial Sequence
  Synthetic
  misc_feature (20)..(21): Sequence is RNA/DNA hybrid, wherein N = T
uuccacacugcuucuugggnn

SEQ ID NO: 294 - DNA, 21 bp, Artificial Sequence
  Synthetic
  misc_feature (20)..(21): Sequence is RNA/DNA hybrid, wherein N = T
cuuauuccguuugcuuauann

SEQ ID NO: 295 - DNA, 21 bp, Artificial Sequence
  Synthetic
  misc_feature (20)..(21): Sequence is RNA/DNA hybrid, wherein N = T
uauaagcaaacggaauaagnn

SEQ ID NO: 296 - DNA, 21 bp, Artificial Sequence
  Synthetic
  misc_feature (20)..(21): Sequence is RNA/DNA hybrid, wherein N = T
guguaugauuugccaggaann

SEQ ID NO: 297 - DNA, 21 bp, Artificial Sequence
  Synthetic
  misc_feature (20)..(21): Sequence is RNA/DNA hybrid, wherein N = T
uuccuggcaaaucauacacnn

SEQ ID NO: 298 - DNA, 21 bp, Artificial Sequence
  Synthetic
  misc_feature (20)..(21): Sequence is RNA/DNA hybrid, wherein N = T
cgcauuucuccugggaggann

SEQ ID NO: 299 - DNA, 21 bp, Artificial Sequence
  Synthetic
  misc_feature (20)..(21): Sequence is RNA/DNA hybrid, wherein N = T
uccucccaggagaaaugcgnn

SEQ ID NO: 300 - DNA, 21 bp, Artificial Sequence
  Synthetic
  misc_feature (20)..(21): Sequence is RNA/DNA hybrid, wherein N = T
gcuucuacguggacgcagann

SEQ ID NO: 301 - DNA, 21 bp, Artificial Sequence
  Synthetic
  misc_feature (20)..(21): Sequence is RNA/DNA hybrid, wherein N = T
ucugcguccacguagaagcnn

SEQ ID NO: 302 - DNA, 21 bp, Artificial Sequence
  Synthetic
  misc_feature (20)..(21): Sequence is RNA/DNA hybrid, wherein N = T
caguguaccuggcggcagunn

SEQ ID NO: 303 - DNA, 21 bp, Artificial Sequence
  Synthetic
  misc_feature (20)..(21): Sequence is RNA/DNA hybrid, wherein N = T
acugccgccagguacacugnn

SEQ ID NO: 304 - DNA, 21 bp, Artificial Sequence
  Synthetic
  misc_feature (20)..(21): Sequence is RNA/DNA hybrid, wherein N = T
gugcuuagcccaggacuuunn

SEQ ID NO: 305 - DNA, 21 bp, Artificial Sequence
  Synthetic
  misc_feature (20)..(21): Sequence is RNA/DNA hybrid, wherein N = T
aaaguccugggcuaagcacnn

SEQ ID NO: 306 - DNA, 21 bp, Artificial Sequence
  Synthetic
  misc_feature (20)..(21): Sequence is RNA/DNA hybrid, wherein N = T
cacuugguaacaggcacaunn

SEQ ID NO: 307 - DNA, 21 bp, Artificial Sequence
  Synthetic
  misc_feature (20)..(21): Sequence is RNA/DNA hybrid, wherein N = T
augugccuguuaccaagugnn

SEQ ID NO: 308 - DNA, 21 bp, Artificial Sequence
  Synthetic
  misc_feature (20)..(21): Sequence is RNA/DNA hybrid, wherein N = T
cacaauuacaccuuguccann

SEQ ID NO: 309 - DNA, 21 bp, Artificial Sequence
  Synthetic
  misc_feature (20)..(21): Sequence is RNA/DNA hybrid, wherein N = T
uggacaagguguaauugugnn

SEQ ID NO: 310 - DNA, 21 bp, Artificial Sequence
  Synthetic
  misc_feature (20)..(21): Sequence is RNA/DNA hybrid, wherein N = T
cuuugagcuugccgcacgunn

SEQ ID NO: 311 - DNA, 21 bp, Artificial Sequence
  Synthetic
  misc_feature (20)..(21): Sequence is RNA/DNA hybrid, wherein N = T
acgugcggcaagcucaaagnn

SEQ ID NO: 312 - DNA, 21 bp, Artificial Sequence
  Synthetic
  misc_feature (20)..(21): Sequence is RNA/DNA hybrid, wherein N = T
cauaggacugcguaugcaunn

SEQ ID NO: 313 - DNA, 21 bp, Artificial Sequence
  Synthetic
  misc_feature (20)..(21): Sequence is RNA/DNA hybrid, wherein N = T
augcauacgcaguccuaugnn

SEQ ID NO: 314 - DNA, 21 bp, Artificial Sequence
  Synthetic
  misc_feature (20)..(21): Sequence is RNA/DNA hybrid, wherein N = T
acgucaacuugcugacacann

SEQ ID NO: 315 - DNA, 21 bp, Artificial Sequence
  Synthetic
  misc_feature (20)..(21): Sequence is RNA/DNA hybrid, wherein N = T
ugugucagcaaguugacgunn

SEQ ID NO: 316 - DNA, 21 bp, Artificial Sequence
  Synthetic
  misc_feature (20)..(21): Sequence is RNA/DNA hybrid, wherein N = T
gugauguggcccaacucuann

SEQ ID NO: 317 - DNA, 21 bp, Artificial Sequence
  Synthetic
  misc_feature (20)..(21): Sequence is RNA/DNA hybrid, wherein N = T
uagaguugggccacaucacnn

SEQ ID NO: 318 - DNA, 21 bp, Artificial Sequence
  Synthetic
  misc_feature (20)..(21): Sequence is RNA/DNA hybrid, wherein N = T
cgggugacgucaacuugcunn

SEQ ID NO: 319 - DNA, 21 bp, Artificial Sequence
  Synthetic
  misc_feature (20)..(21): Sequence is RNA/DNA hybrid, wherein N = T
agcaaguugacgucacccgnn

SEQ ID NO: 320 - DNA, 21 bp, Artificial Sequence
  Synthetic
  misc_feature (20)..(21): Sequence is RNA/DNA hybrid, wherein N = T
ccuguuauggaauccucaann

SEQ ID NO: 321 - DNA, 21 bp, Artificial Sequence
  Synthetic
  misc_feature (20)..(21): Sequence is RNA/DNA hybrid, wherein N = T
uugaggauuccauaacaggnn

SEQ ID NO: 322 - DNA, 21 bp, Artificial Sequence
  Synthetic
  misc_feature (20)..(21): Sequence is RNA/DNA hybrid, wherein N = T
acaucuuucccauuagcucnn

SEQ ID NO: 323 - DNA, 21 bp, Artificial Sequence
  Synthetic
  misc_feature (20)..(21): Sequence is RNA/DNA hybrid, wherein N = T
gagcuaaugggaaagaugunn

SEQ ID NO: 324 - DNA, 21 bp, Artificial Sequence
  Synthetic
  misc_feature (20)..(21): Sequence is RNA/DNA hybrid, wherein N = T
gaagucaaguucaaguccunn

SEQ ID NO: 325 - DNA, 21 bp, Artificial Sequence
  Synthetic
  misc_feature (20)..(21): Sequence is RNA/DNA hybrid, wherein N = T
aggacuugaacuugacuucnn

SEQ ID NO: 326 - DNA, 21 bp, Artificial Sequence
  Synthetic
  misc_feature (20)..(21): Sequence is RNA/DNA hybrid, wherein N = T
gagacaacgguuaccgugann

SEQ ID NO: 327 - DNA, 21 bp, Artificial Sequence
  Synthetic
  misc_feature (20)..(21): Sequence is RNA/DNA hybrid, wherein N = T
ucacgguaaccguugucucnn

SEQ ID NO: 328 - DNA, 21 bp, Artificial Sequence
  Synthetic
  misc_feature (20)..(21): Sequence is RNA/DNA hybrid, wherein N = T
gucacugagacaacgguuann

SEQ ID NO: 329 - DNA, 21 bp, Artificial Sequence
  Synthetic
  misc_feature (20)..(21): Sequence is RNA/DNA hybrid, wherein N = T
uaaccguugucucagugacnn

SEQ ID NO: 330 - DNA, 21 bp, Artificial Sequence
  Synthetic
  misc_feature (20)..(21): Sequence is RNA/DNA hybrid, wherein N = T
gugucugucuggcccuaaann

SEQ ID NO: 331 - DNA, 21 bp, Artificial Sequence
  Synthetic
  misc_feature (20)..(21): Sequence is RNA/DNA hybrid, wherein N = T
uuuagggccagacagacacnn

SEQ ID NO: 332 - DNA, 21 bp, Artificial Sequence
  Synthetic
  misc_feature (20)..(21): Sequence is RNA/DNA hybrid, wherein N = T
caccuaaugcauuuagugann

SEQ ID NO: 333 - DNA, 21 bp, Artificial Sequence
  Synthetic
  misc_feature (20)..(21): Sequence is RNA/DNA hybrid, wherein N = T
ucacuaaaugcauuaggugnn

SEQ ID NO: 334 - DNA, 21 bp, Artificial Sequence
  Synthetic
  misc_feature (20)..(21): Sequence is RNA/DNA hybrid, wherein N = T
cagaaaguggaagucucaann

SEQ ID NO: 335 - DNA, 21 bp, Artificial Sequence
  Synthetic
  misc_feature (20)..(21): Sequence is RNA/DNA hybrid, wherein N = T
uugagacuuccacuuucugnn

SEQ ID NO: 336 - DNA, 21 bp, Artificial Sequence
  Synthetic
  misc_feature (20)..(21): Sequence is RNA/DNA hybrid, wherein N = T
guaucguagucugaccuaunn

SEQ ID NO: 337 - DNA, 21 bp, Artificial Sequence
  Synthetic
  misc_feature (20)..(21): Sequence is RNA/DNA hybrid, wherein N = T
auaggucagacuacgauacnn

SEQ ID NO: 338 - DNA, 21 bp, Artificial Sequence
  Synthetic
  misc_feature (20)..(21): Sequence is RNA/DNA hybrid, wherein N = T
guuuguaggagaagccuuann

SEQ ID NO: 339 - DNA, 21 bp, Artificial Sequence
  Synthetic
  misc_feature (20)..(21): Sequence is RNA/DNA hybrid, wherein N = T
uaaggcuucuccuacaaacnn

SEQ ID NO: 340 - DNA, 21 bp, Artificial Sequence
  Synthetic
  misc_feature (20)..(21): Sequence is RNA/DNA hybrid, wherein N = T
guguagacaugcuccgggann

SEQ ID NO: 341 - DNA, 21 bp, Artificial Sequence
  Synthetic
  misc_feature (20)..(21): Sequence is RNA/DNA hybrid, wherein N = T
ucccggagcaugucuacacnn

SEQ ID NO: 342 - DNA, 21 bp, Artificial Sequence
  Synthetic
  misc_feature (20)..(21): Sequence is RNA/DNA hybrid, wherein N = T
caaacucauuacugucaaunn

SEQ ID NO: 343 - DNA, 21 bp, Artificial Sequence
  Synthetic
  misc_feature (20)..(21): Sequence is RNA/DNA hybrid, wherein N = T
auugacaguaaugaguuugnn

SEQ ID NO: 344 - DNA, 21 bp, Artificial Sequence
  Synthetic
  misc_feature (20)..(21): Sequence is RNA/DNA hybrid, wherein N = T
ccauuucaggucacaccuunn

SEQ ID NO: 345 - DNA, 21 bp, Artificial Sequence
  Synthetic
  misc_feature (20)..(21): Sequence is RNA/DNA hybrid, wherein N = T
aaggugugaccugaaauggnn

SEQ ID NO: 346 - DNA, 21 bp, Artificial Sequence
  Synthetic
  misc_feature (20)..(21): Sequence is RNA/DNA hybrid, wherein N = T
cagauauacaguugugugunn

SEQ ID NO: 347 - DNA, 21 bp, Artificial Sequence
  Synthetic
  misc_feature (20)..(21): Sequence is RNA/DNA hybrid, wherein N = T
acacacaacuguauaucugnn

SEQ ID NO: 348 - DNA, 21 bp, Artificial Sequence
  Synthetic
  misc_feature (20)..(21): Sequence is RNA/DNA hybrid, wherein N = T
gaacuuauacagaaugguunn

SEQ ID NO: 349 - DNA, 21 bp, Artificial Sequence
  Synthetic
  misc_feature (20)..(21): Sequence is RNA/DNA hybrid, wherein N = T
aaccauucuguauaaguucnn

SEQ ID NO: 350 - DNA, 21 bp, Artificial Sequence
  Synthetic
  misc_feature (20)..(21): Sequence is RNA/DNA hybrid, wherein N = T
cacacgcugucagaggaugnn

SEQ ID NO: 351 - DNA, 21 bp, Artificial Sequence
  Synthetic
  misc_feature (20)..(2): Sequence is RNA/DNA hybrid, wherein N = T
  misc_feature (20)..(21): n is a, c, g, t or u
cauccucugacagcgugugnn

SEQ ID NO: 352 - DNA, 21 bp, Artificial Sequence
  Synthetic
  misc_feature (20)..(21): Sequence is RNA/DNA hybrid, wherein N = T
gagaccuguugaggaagucnn

SEQ ID NO: 353 - DNA, 21 bp, Artificial Sequence
  Synthetic
  misc_feature (20)..(21): Sequence is RNA/DNA hybrid, wherein N = T
gacuuccucaacaggucucnn

SEQ ID NO: 354 - DNA, 21 bp, Artificial Sequence
  Synthetic
  misc_feature (20)..(21): Sequence is RNA/DNA hybrid, wherein N = T
cgaauagccagagaccugunn

SEQ ID NO: 355 - DNA, 21 bp, Artificial Sequence
  Synthetic
  misc_feature (20)..(21): Sequence is RNA/DNA hybrid, wherein N = T
acaggucucuggcuauucgnn

SEQ ID NO: 356 - DNA, 21 bp, Artificial Sequence
  Synthetic
  misc_feature (20)..(21): Sequence is RNA/DNA hybrid, wherein N = T
gauuaaagaggcaauugaunn

SEQ ID NO: 357 - DNA, 21 bp, Artificial Sequence
  Synthetic
  misc_feature (20)..(21): Sequence is RNA/DNA hybrid, wherein N = T
aucaauugccucuuuaaucnn

SEQ ID NO: 358 - DNA, 21 bp, Artificial Sequence
  Synthetic
  misc_feature (20)..(21): Sequence is RNA/DNA hybrid, wherein N = T
gcguuaucuuccagaugaunn

SEQ ID NO: 359 - DNA, 21 bp, Artificial Sequence
  Synthetic
  misc_feature (20)..(21): Sequence is RNA/DNA hybrid, wherein N = T
aucaucuggaagauaacgcnn

SEQ ID NO: 360 - DNA, 21 bp, Artificial Sequence
  Synthetic
  misc_feature (20)..(21): Sequence is RNA/DNA hybrid, wherein N = T
cacuaauacaccuccuguann

SEQ ID NO: 361 - DNA, 21 bp, Artificial Sequence
  Synthetic
  misc_feature (20)..(21): Sequence is RNA/DNA hybrid, wherein N = T
uacaggagguguauuagugnn

SEQ ID NO: 362 - DNA, 21 bp, Artificial Sequence
  Synthetic
  misc_feature (20)..(21): Sequence is RNA/DNA hybrid, wherein N = T
cguacgcggaauacuucgann

SEQ ID NO: 363 - DNA, 21 bp, Artificial Sequence
  Synthetic
  misc_feature (20)..(21): Sequence is RNA/DNA hybrid, wherein N = T
ucgaaguauuccgcguacgnn

SEQ ID NO: 364 - DNA, 21 bp, Artificial Sequence
  Synthetic
  misc_feature (20)..(21): Sequence is RNA/DNA hybrid, wherein N = T
aaaggacaacugcagcuacnn

SEQ ID NO: 365 - DNA, 21 bp, Artificial Sequence
  Synthetic
  misc_feature (20)..(21): Sequence is RNA/DNA hybrid, wherein N = T
guagcugcaguuguccuuunn

SEQ ID NO: 366 - DNA, 981 bp, Homo sapien
  CDS (1)..(981)
atggagaaggacggcctgtgccgcgctgaccagcagtacgaatgcgtggcggagatcggggagggcgcctatgggaaggtgttcaaggcccgcgacttgaagaacggaggccgtttcgtggcgttgaagcgcgtgcgggtgcagaccggcgaggagggcatgccgctctccaccatccgcgaggtggcggtgctgaggcacctggagaccttcgagcaccccaacgtggtcaggttgtttgatgtgtgcacagtgtcacgaacagacagagaaaccaaactaactttagtgtttgaacatgtcgatcaagacttgaccacttacttggataaagttccagagcctggagtgcccactgaaaccataaaggatatgatgtttcagcttctccgaggtctggactttcttcattcacaccgagtagtgcatcgcgatctaaaaccacagaacattctggtgaccagcagcggacaaataaaactcgctgacttcggccttgcccgcatctatagtttccagatggctctaacctcagtggtcgtcacgctgtggtacagagcacccgaagtcttgctccagtccagctacgccacccccgtggatctctggagtgttggctgcatatttgcagaaatgtttcgtagaaagcctctttttcgtggaagttcagatgttgatcaactaggaaaaatcttggacgtgattggactcccaggagaagaagactggcctagagatgttgcccttcccaggcaggcttttcattcaaaatctgcccaaccaattgagaagtttgtaacagatatcgatgaactaggcaaagacctacttctgaagtgtttgacatttaacccagccaaaagaatatctgcctacagtgccctgtctcacccatacttccaggacctggaaaggtgcaaagaaaacctggattcccacctgccgcccagccagaacacctcggagctgaatacagcctga

SEQ ID NO: 367 - protein, 326 aa, Homo sapien
MEKDGLCRADQQYECVAEIGEGAYGKVFKARDLKNGGRFVALKRVRVQTGEEGMPLSTIREVAVLRHLETFEHPNVVRLFDVCTVSRTDRETKLTLVFEHVDQDLTTYLDKVPEPGVPTETIKDMMFQLLRGLDFLHSHRVVHRDLKPQNILVTSSGQIKLADFGLARIYSFQMALTSVVVTLWYRAPEVLLQSSYATPVDLWSVGCIFAEMFRRKPLFRGSSDVDQLGKILDVIGLPGEEDWPRDVALPRQAFHSKSAQPIEKFVTDIDELGKDLLLKCLTFNPAKRISAYSALSHPYFQDLERCKENLDSHLPPSQNTSELNTA

SEQ ID NO: 368 - DNA, 3277 bp, Homo sapien
  CDS (129)..(2603)
aatcgctcggcctcccccatcccccgggtaacggtcgctggtgagtttaaatgagcaggggctggccgggccggagccgctacagggggggcctgaggcactgcagaaagtgggcctgagcctcgaggatgacggtgctgcaggaacccgtccaggctgctatatggcaagcactaaaccactatgcttaccgagatgcggttttcctcgcagaacgcctttatgcagaagtacactcagaagaagccttgtttttactggcaacctgttattaccgctcaggaaaggcatataaagcatatagactcttgaaaggacacagttgtactacaccgcaatgcaaatacctgcttgcaaaatgttgtgttgatctcagcaagcttgcagaaggggaacaaatcttatctggtggagtgtttaataagcagaaaagccatgatgatattgttactgagtttggtgattcagcttgctttactctttcattgttgggacatgtatattgcaagacagatcggcttgccaaaggatcagaatgttaccaaaagagccttagtttaaatcctttcctctggtctccctttgaatcattatgtgaaataggtgaaaagccagatcctgaccaaacatttaaattcacatctttacagaactttagcaactgtctgcccaactcttgcacaacacaagtacctaatcatagtttatctcacagacagcctgagacagttcttacggaaacaccccaggacacaattgaattaaacagattgaatttagaatcttccaattcaaagtactccttgaatacagattcctcagtgtcttatattgattcagctgtaatttcacctgatactgtcccactgggaacaggaacttccatattatctaaacaggttcaaaataaaccaaaaactggtcgaagtttattaggaggaccagcagctcttagtccattaaccccaagttttgggattttgccattagaaaccccaagtcctggagatggatcctatttacaaaactacactaatacacctcctgtaattgatgtgccatccaccggagccccttcaaaaaagtctgttgccagaatcggccaaactggaacaaagtctgtcttctcacagagtggaaatagccgagaggtaactccaattcttgcacaaacacaaagttctggtccacaaacaagtacaacacctcaggtattgagccccactattacatctcccccaaacgcactgcctcgaagaagttcacgactctttactagtgacagctccacaaccaaggagaatagcaaaaaattaaaaatgaagtttccacctaaaatcccaaacagaaaaacaaaaagtaaaactaataaaggaggaataactcaacctaacataaatgatagcctggaaattacaaaattggactcttccatcatttcagaagggaaaatatccacaatcacacctcagattcaggcctttaatctacaaaaagcagcagcagcaggtttgatgagccttcttcgtgaaatggggaaaggttatttagctttgtgttcatacaactgcaaagaagctataaatattttgagccatctaccttctcaccactacaatactggttgggtactgtgccaaattggaagggcctattttgaactttcagagtacatgcaagctgaaagaatattctcagaggttagaaggattgagaattatagagttgaaggcatggagatctactctacaacactttggcatcttcaaaaagatgttgctctttcagttctgtcaaaagacttaacagacatggataaaaattcgccagaggcctggtgtgctgcagggaactgtttcagtctgcaacgggaacatgatattgcaattaaattcttccagagagctatccaagttgatccaaattacgcttatgcctatactctattagggcatgagtttgtcttaactgaagaattggacaaagcattagcttgttttcgaaatgctatcagagtcaatcctagacattataatgcatggtatggtttaggaatgatttattacaagcaagaaaaattcagccttgcagaaatgcatttccaaaaagcgcttgatatcaaccctcaaagttcagttttactttgccacattggagtagttcaacatgcactgaaaaaatcagagaaggctttggataccctaaacaaagccattgtcattgatcccaagaaccctctatgcaaatttcacagagcctcagttttatttgcaaatgaaaaatataagtctgctttacaagaacttgaagaattgaaacaaattgttcccaaagaatccctcgtttacttcttaataggaaaggtttacaagaagttaggtcaaacgcacctcgccctgatgaatttctcttgggctatggatttagatcctaaaggagccaataaccagattaaagaggcaattgataagcgttatcttccagatgatgaggagccaataacccaagaagaacagatcatgggaacagatgaatcccaggagagcagcatgacagatgcggatgacacacaacttcatgcagctgaaagtgatgaattttaacttctggaaatcagacttttacaactggatgtgtgactagtgctgacgtgtttcttgtccctctgtatactgagtctttactcttgagctggcggtgtcatcgtccgtcacttataccatgagtgtgccactttcattggaccctgactgtatacagaatgaaaggcagtgcaatatttagctgctaacaagactggctcttttaccagtatgaatgacaatttatggggggtagggtggggaactttcttttctgtttttctttaatctccctttgttggaaagtatcatgaaggaagagttatgctttatcttgaaggaaccattagatatggaaaatagtgatgaaccagagtttcttggttgctttttcaaaaatttgtttttatttggttctgttccagataaacagagtaactgaccttcatttctaggttcttcaagaatggtgtttgcaagtgccagatggaacaataaaagacgttgcctataacagtgacttgattgccaaggaatgtaaattaccttaaacttcgatgatctcccataaacaaatgtaatgggcatattgggactcgtatgtaggaatcaaatatccctccatacagtgtactcttattcttggcaagaatgctttaatgtataaccaagaattttaatttattcatcttgct

SEQ ID NO: 369 - protein, 824 aa, Homo sapien
MTVLQEPVQAAIWQALNHYAYRDAVFLAERLYAEVHSEEALFLLATCYYRSGKAYKAYRLLKGHSCTTPQCKYLLAKCCVDLSKLAEGEQILSGGVFNKQKSHDDIVTEFGDSACFTLSLLGHVYCKTDRLAKGSECYQKSLSLNPFLWSPFESLCEIGEKPDPDQTFKFTSLQNFSNCLPNSCTTQVPNHSLSHRQPETVLTETPQDTIELNRLNLESSNSKYSLNTDSSVSYIDSAVISPDTVPLGTGTSILSKQVQNKPKTGRSLLGGPAALSPLTPSFGILPLETPSPGDGSYLQNYTNTPPVIDVPSTGAPSKKSVARIGQTGTKSVFSQSGNSREVTPILAQTQSSGPQTSTTPQVLSPTITSPPNALPRRSSRLFTSDSSTTKENSKKLKMKFPPKIPNRKTKSKTNKGGITQPNINDSLEITKLDSSIISEGKISTITPQIQAFNLQKAAAAGLMSLLREMGKGYLALCSYNCKEAINILSHLPSHHYNTGWVLCQIGRAYFELSEYMQAERIFSEVRRIENYRVEGMEIYSTTLWHLQKDVALSVLSKDLTDMDKNSPEAWCAAGNCFSLQREHDIAIKFFQRAIQVDPNYAYAYTLLGHEFVLTEELDKALACFRNAIRVNPRHYNAWYGLGMIYYKQEKFSLAEMHFQKALDINPQSSVLLCHIGVVQHALKKSEKALDTLNKAIVIDPKNPLCKFHRASVLFANEKYKSALQELEELKQIVPKESLVYFLIGKVYKKLGQTHLALMNFSWAMDLDPKGANNQIKEAIDKRYLPDDEEPITQEEQIMGTDESQESSMTDADDTQLHAAESDEF

SEQ ID NO: 370 - DNA, 3912 bp, Homo sapien
  CDS (4)..(3102)
gccatgccgggccgggcggaggcgggggaggccgaggaggaggccggggccggctcggggtctgaggcggaggaggacgcgctgtgggagcgaatcgagggcgtccggcatcggctggctcgcgccctgaacccggccaagctcacgccgtatctgcgccagtgccgggtcatcgacgagcaggacgaggaggaggtgctgagcacctaccgcttcccgtgccgcgtcaaccgcaccgggcgcctgatggacatcttgcgctgccgtggcaagaggggctatgaggccttcctggaagccctggagttctactaccccgaacacttcacgctgctcacgggccaggaacccgcccagcgctgctccatgatcctcgatgaggaggggcctgagggcctgacccaattcttgatgacagaggtgcgacggctgcgggaagctcgcaagagccagctgcagcgggagcagcaactgcaggcccggggccgggtgctcgaggaggagcgggcagggctggagcagcggctgcgggaccagcagcaggctcaggagcgctgtcaacggctgcgggaggactgggaggcgggcagcctggagctgctgcggctcaaggatgagaactacatgatcgccatgcgcctggcacagctcagtgaggagaagaactcggctgtacttcgcagccgtgacctgcagctggcggtggatcagctcaagctcaaagtgagtcggctggaggaagagtgtgcactgcttcgaagggccaggggcccgccccctggggcagaggagaaggagaaggagaaggagaaggagaaggagccagacaatgtggaccttgtctctgagctgcgtgctgagaaccagcggctgacggcgtcactgcgggagttgcaggagggcctgcagcaggaggcgagccggccgggggccccgggctccgagcgcatcctgctggacatcctagagcatgactggcgggaggcgcaggacagcaggcaggagctgtgccagaagctgcatgccgtgcagggggagctgcagtgggccgaggagctgcgcgaccagtacctgcaggagatggaagacctgcggctcaagcaccgcacgctgcagaaggactgtgacctgtacaagcaccgcatggccactgtcctggcccaactggaggagattgagaaggagcgagaccaggccatccagagccgtgaccggatccagttgcagtactcacagagcctcatcgagaaggaccagtaccgcaagcaggtgcggggcctggaggcggagcgggatgagctgctgacaacgctcaccagcctggagggcaccaaggctctgctggaggttcagctgcagcgggcccagggtggcacctgcctcaaggcctgtgcctcctcccattccctgtgctccaacctcagcagcacttggagcctgagcgagttcccctcccctctgggaggcccagaagcaactggggaggcagctgtcatggggggacctgagcctcacaactcggaggaagccacagacagtgaaaaggagatcaatcggctctccatcctgcccttcccccccagtgccggctccatcctccgccggcagcgtgaggaagaccccgcaccccctaagagatccttcagcagcatgtcagacatcacagggagtgtgacacttaagccctggtcccctggcctctcttcgtcctcatcctctgacagcgtgtggcctttgggaaagccggaaggcctcctggctcggggctgtggcctggacttcctcaacaggtctctggctattcgggtgtctggccggagccccccagggggcccagagccgcaggacaagggaccagatggactgtcgttttatggggacagatggtctggggctgtggtgcgcagggtgctgtctgggcctgggtccgccaggatggaaccaagagagcaaagggtggaagctgctggtctggagggggcgtgcctggaagccgaggcccagcagagaaccttgctctggaatcaggggtccacactcccctccctgatggactcgaaggcctgccagtccttccacgaggccctagaagcctgggcaaagggaccaggtgccgagcccttctacattcgtgccaacctcaccttgcctgagagggcagatccccatgccctttgcgtgaaagcccaagagatccttcgactggtggactcggcatacaagcggaggcaggaatggttctgcacccgggttgaccccctcactctgcgggacctggaccggggcaccgtgcccaattatcagagagcccagcagctcctagaagttcaggagaaatgcctgccctccagccggcaccgaggcccccgcagtaatctgaagaagagagccctggaccagctgcggctggtgaggcccaagcccgtgggggcgcctgcaggggactccccggatcagctgctgctggagccctgtgcagagccggagcggagcctcagaccctacagtttggtgcggccgctactggtgtctgccctgcggcccgtggtgctgttgcctgagtgcctggcgccccggctcatccgtaacctgctagacctgcccagctcccggctggacttccaagtgtgcccagcggaaagcctctctggggaggaactgtgcccatcctcagcgcctggagcccccaaggctcagcctgccacccctgggctaggcagcaggatccgggccatccaggagtctgttgggaagaagcactgcctgctggagctgggtgctcggggtgtgcgggagctggtgcagaacgagatctaccccatcgtcatccacgtggaggtgactgagaagaatgtccgggaagtcaggggtctgctgggccggccgggctggcgggactcagagctgctgcggcagtgccgtggctcagagcaggtgctctgggggctgccctgctcctgggtgcaggtgcccgcccatgagtggggacacgcagaggagctggccaaggtggtgcgcggccgcatcctgcaggagcaggcccgcctcgtgtgggtggagtgcggcagcagcagaggctgccccagcagcagtgaggcctgaggctcatctgatacctgcaccttctccccaagccagcgtggaccctggtgtctatggtgaagctgggccctcccaccctgagccttcctagacccttggactctcagatgcagggcccttggctctggcctctcacccccaaggctgtctctggccctgccgagcctatgggagtcccgggacagagtgcccactcccctctacttgctgctctgggcctccccacctttcctggggtctccacattcccactagtgggtcttatgtgtgtctgtgtcttctccttaaacactcgccctggagtctgttctcacacctgtgcgcaggtttgcacactcaagttctcatgggcaggctcaggtctgtcccgctgccctgggcacgaggtctcctgaggacctgggcctgttctgctcctaggagacctgagcccgttaccgcgtgactcccaccatccagctcgcgctcctcgtggattcagccatgcatggactggggtgttccctggcccatggtcacctgtgcccctcgtgtctcctcacatgggtgtctgtggttctctcctgtgtaaatgtcacgccccacccctgtttcatgtgggcactaacacgtgtgcgttcctggcgggcacactcaggaccgtgcctcacagggcccactccctgcctatgcctccctcttggggggccgaggagggcggctgctctgtcatgagaatgtacggcccgtggatgattaacgggcctttttcacttagaagctgcacattatggagcattaaacacttttgtcatagaaaaaaaaaaaaaa

SEQ ID NO: 371 - protein, 1032 aa, Homo sapien
MPGRAEAGEAEEEAGAGSGSEAEEDALWERIEGVRHRLARALNPAKLTPYLRQCRVIDEQDEEEVLSTYRFPCRVNRTGRLMDILRCRGKRGYEAFLEALEFYYPEHFTLLTGQEPAQRCSMILDEEGPEGLTQFLMTEVRRLREARKSQLQREQQLQARGRVLEEERAGLEQRLRDQQQAQERCQRLREDWEAGSLELLRLKDENYMIAMRLAQLSEEKNSAVLRSRDLQLAVDQLKLKVSRLEEECALLRRARGPPPGAEEKEKEKEKEKEPDNVDLVSELRAENQRLTASLRELQEGLQQEASRPGAPGSERILLDILEHDWREAQDSRQELCQKLHAVQGELQWAEELRDQYLQEMEDLRLKHRTLQKDCDLYKHRMATVLAQLEEIEKERDQAIQSRDRIQLQYSQSLIEKDQYRKQVRGLEAERDELLTTLTSLEGTKALLEVQLQRAQGGTCLKACASSHSLCSNLSSTWSLSEFPSPLGGPEATGEAAVMGGPEPHNSEEATDSEKEINRLSILPFPPSAGSILRRQREEDPAPPKRSFSSMSDITGSVTLKPWSPGLSSSSSSDSVWPLGKPEGLLARGCGLDFLNRSLAIRVSGRSPPGGPEPQDKGPDGLSFYGDRWSGAVVRRVLSGPGSARMEPREQRVEAAGLEGACLEAEAQQRTLLWNQGSTLPSLMDSKACQSFHEALEAWAKGPGAEPFYIRANLTLPERADPHALCVKAQEILRLVDSAYKRRQEWFCTRVDPLTLRDLDRGTVPNYQRAQQLLEVQEKCLPSSRHRGPRSNLKKRALDQLRLVRPKPVGAPAGDSPDQLLLEPCAEPERSLRPYSLVRPLLVSALRPVVLLPECLAPRLIRNLLDLPSSRLDFQVCPAESLSGEELCPSSAPGAPKAQPATPGLGSRIRAIQESVGKKHCLLELGARGVRELVQNEIYPIVIHVEVTEKNVREVRGLLGRPGWRDSELLRQCRGSEQVLWGLPCSWVQVPAHEWGHAEELAKVVRGRILQEQARLVWVECGSSRGCPSSSEA

SEQ ID NO: 372 - DNA, 4335 bp, Homo sapien
  CDS (485)..(1405)
gaggccgggcagggggcggggccggcgaatgcccgtcccgacccgtcgcgcctcccctgttagctccctgccagccgaggcggggcgaacctctgccctgttgcgtgggagtgactcacagctcccgccccttttggctccgctttctcgcggccagtccctcgcaccacgtgccctcctggccgcgcccccagctgccctttccaactgcctgttggaagccgctgtaaaacgtcgtgaggagcgccgctgctttacggctgcctctcccagactagagccccggagcgcccaccgccgtcagccgcgtcttcaagctagtcggccccgcggagagcgagagaccctgcgcaccgcagccctctccgctgcgcccattcctgccgccggcgatgtaactcggggaggcagcggtgcccgctggcccggggttgagacaggcggcaggtgcctgtgaggcgggcgggtgccgggggccagcaggatggaggaaagcatggaagaggaggaggggggcagctacgaggcgatgatggacgaccagaaccacaacaactgggaggctgcggtggacggcttccggcagcccctgccacctccgccgcccccctcgtcgatcccggcccctgcccgagagcctccgggggggcagctgctggcggtgcccgcggtctccgtggacaggaaaggccccaaggaggggctcccgatggggccgcagccaccgccggaggctaatggggtgatcatgatgttgaagagctgcgacgcggccgccgccgtggccaaggcggcccccgcccccaccgccagctccaccatcaacatcaacacctccacctccaagttcttaatgaatgttataactattgaagattataagagcacatactggccaaaattggatggtgccatagatcaacttttaactcagagtcctggtgactatatccccatatcctatgaacagatatacagttgtgtgtataaatgtgtatgccagcagcactcggaacagatgtatagtgatctgattaaaaagataactaatcacttagagagagtctcaaaggagctgcaggccagccctccagatctctatattgaaagatttaatatagctcttggacaatatatgggagcattgcagagcattgtgcctcttttcatatatatgaataagttttacatcgaaaccaagcttaacagagacttaaaagatgaccttataaagctgtttacggaacatgttgcagaaaagcacatttacagcctaatgcctttacttttagaagcccagtcaacaccatttcaggtcacaccttcaactatggcaaatattgtgaaaggcctgtataccctcagaccagtagtgggttcagatggctccaactctattttctaaatttattccaaacattctccctccggcggtggaatctgaactttctgaatatgctgctcaagatcagaaatttcaaagagaacttatacagaatggttttacaaggggtgaccagtcccggaagagagctggggatgagttggcttataatagctcgtcagcatgtgcaagttccagggggtacagatagtgaatgtattgaatatgctttccttcctgaaaagaggacacactggagctgcagagactgtattcagagcacagtgggggctgcacacactcaggagctctgtcacaaagctgttcatggaagaggatgttggacttcttacttggtttgtaattttaaaacaaaaactaaaaaaaaaaaaaacgttgctgctagacttgggggtgattttgaaatgggacaatcttttaatgagtttatctacagattctgtgaggaaaaagcatctcagaaagtgaccatttctaagtgaaatctgacagccaaaatcagcagcttcctccaaaaatataagagcagaagaattttttttttaagcacttgttttgttcatttgtggacttggcattttggtgtattggtttcacatgtcaggatctcttttgctttaaaaccaagcagatcattacagtacagtatttttcacccacaaccaaaacaaccccttttaaaagagttggtctttgtttagcattagaaagtcttgttaaaggaaaatgctaactctgcttttgctagaactttcccccatcagttcacaactttcttctactctgtgccttgagctttgtgcactttgcaactgtgtgaccatgttgtcaaactcctcctggagaagtgtatggtatctaaactcacccaccaagatggcaggtgtggccctgtagcaggatgctaattaagtgggaaaatagaaaccttttgcacatgggtcggattttcccctggttcaccagagcatattcatattaatgttggggaccaactctcctagagcatttccattccctgtgccacttaacacgatgtctgtcaccagctgctatagtattggcagtactctagtttagggatgggcggtactttagcacggaagcttcccttagtattattgagagctacttcctgcgatgctctaggaagcagatacagttattaagtccaaatacacagtggtgtggggttcctgatcacttcattttaaatgaatgagataattacttaaaaaaagtctgtcatttgaacattatatttgagtgtgatagggaagaagtagcactgctgtcctaaggctcccttccagctgtggcaaagctatatttctgtttctccacatccacagtgctttttagtccatcataaaagtttctgaagcttattctagctgttgttgaaagcccaagaaaaatagatgtggcaagagaaaaatacttttcttctcaattttgcttgaatcttaattgagcataggcttctctactaggcaacatcagactaatagtatttacctcttcagagaacttgaggggaaaagaaacatcccagggatgctgtcgcatgtctgctctgcaggttcttcatacagctgcctctgccaattcagtttattttttggggggagtggtgtgggtgggagagttagaagtgggatattgggagcaagtaagtcacccaataattgaagtccttgatttgtaaaactgttatacagagaagtaaagataaaggttgtcagatttattttttaaagtacttaaccagagttcgtggattttgtggactttaattggactcaattcactctgtgagcatcctggattgcatcgatgaacactgaattactgtaagaacatagacaggctctcactatgacctggacagtttaagttgctacactggtaacattctagtatcaaggagaattccattcatcatgacattcacattttacttttctcaatggaatgcttgcttcaggcttaccaatcacacctagaactgaagtctgagtgagtggtattaataatttttctgaaaggaataaaattggaatgtttctaaatgtggagaaattcttcagtatcctaataatatacccaaatgctttttctgggagagagcattcttttacaaaagaactttccctataaaagcatcacagtataatgtgaattggcattaaaatctttggatgcttttgcattattaaagttcatggagaaatatattctttttactatgtatgtattaataaaaagtgggcaaagtaaagtttgcaaaatttagtttctctaaatttttgcacagtgactgcagctggctatgggtcagctcttaatacaacaaaaccttgactggaagtcactatagaaaggttgtacatagtctcccagtctacatgtcctggctgttaatcatcttggccccttgaggcacatcacagtttgaaggacctgtttaagttgaaatagactttgcttatttattgggattctaaaaaattctgagtgagtttgcagtatgagaggaaataagatttcctcctccttcctctcattttatattgactgtttgccagaaactgttttcttctgttttcttatattttgtttttgagatggagtctcactctctcacccaggctggagtgcagtggtgcaatctcagctcactgcaacctctgcctcctgggttcaagtgattctcctgcctcggcctcctgagtagctggaattacaggcacgtgccactacgcccggctactttttgtattttgtttttagtagagacggggtttcaccatgttggtcaggctggtcttgaactcctgacctcaagtgatccacccacctcggcctcccaaagtgctgggattataggtgtgagccactgcacctggccaaaaaaaaaaaaaaaaaaa

SEQ ID NO: 373 - protein, 306 aa, Homo sapien
MEESMEEEEGGSYEAMMDDQNHNNWEAAVDGFRQPLPPPPPPSSIPAPAREPPGGQLLAVPAVSVDRKGPKEGLPMGPQPPPEANGVIMMLKSCDAAAAVAKAAPAPTASSTININTSTSKFLMNVITIEDYKSTYWPKLDGAIDQLLTQSPGDYIPISYEQIYSCVYKCVCQQHSEQMYSDLIKKITNHLERVSKELQASPPDLYIERFNIALGQYMGALQSIVPLFIYMNKFYIETKLNRDLKDDLIKLFTEHVAEKHIYSLMPLLLEAQSTPFQVTPSTMANIVKGLYTLRPVVGSDGSNSIF

SEQ ID NO: 374 - DNA, 21 bp, Artificial Sequence
  Synthetic
  misc_feature (20)..(21): Sequence is RNA/DNA hybrid, wherein N = T
cuuaugaugccauucaugunn

SEQ ID NO: 375 - DNA, 21 bp, Artificial Sequence
  Synthetic
  misc_feature (20)..(21): Sequence is RNA/DNA hybrid, wherein N = T
acaugaauggcaucauaagnn

SEQ ID NO: 376 - DNA, 21 bp, Artificial Sequence
  Synthetic
  misc_feature (20)..(21): Sequence is RNA/DNA hybrid, wherein N = T
cauacauggauucuccacann

SEQ ID NO: 377 - DNA, 21 bp, Artificial Sequence
  Synthetic
  misc_feature (20)..(21): Sequence is RNA/DNA hybrid, wherein N = T
uguggagaauccauguaugnn

SEQ ID NO: 378 - DNA, 21 bp, Artificial Sequence
  Synthetic
  misc_feature (20)..(21): Sequence is RNA/DNA hybrid, wherein N = T
caguuaaagcccggaggaann

SEQ ID NO: 379 - DNA, 21 bp, Artificial Sequence
  Synthetic
  misc_feature (20)..(21): Sequence is RNA/DNA hybrid, wherein N = T
uuccuccgggcuuuaacugnn

SEQ ID NO: 380 - DNA, 21 bp, Artificial Sequence
  Synthetic
  misc_feature (20)..(21): Sequence is RNA/DNA hybrid, wherein N = T
cucuugagaaugugccgaunn

SEQ ID NO: 381 - DNA, 21 bp, Artificial Sequence
  Synthetic
  misc_feature (20)..(21): Sequence is RNA/DNA hybrid, wherein N = T
aucggcacauucucaagagnn

SEQ ID NO: 382 - DNA, 21 bp, Artificial Sequence
  Synthetic
  misc_feature (20)..(21): Sequence is RNA/DNA hybrid, wherein N = T
cacauugauggaaggucaann

SEQ ID NO: 383 - DNA, 21 bp, Artificial Sequence
  Synthetic
  misc_feature (20)..(21): Sequence is RNA/DNA hybrid, wherein N = T
uugaccuuccaucaaugugnn

SEQ ID NO: 384 - DNA, 21 bp, Artificial Sequence
  Synthetic
  misc_feature (20)..(21): Sequence is RNA/DNA hybrid, wherein N = T
guccaaagcagcauauguann

SEQ ID NO: 385 - DNA, 21 bp, Artificial Sequence
  Synthetic
  misc_feature (20)..(21): Sequence is RNA/DNA hybrid, wherein N = T
uacauaugcugcuuuggacnn

SEQ ID NO: 386 - DNA, 21 bp, Artificial Sequence
  Synthetic
  misc_feature (20)..(21): Sequence is RNA/DNA hybrid, wherein N = T
gaccuaugcuccugggauann

SEQ ID NO: 387 - DNA, 21 bp, Artificial Sequence
  Synthetic
  misc_feature (20)..(21): Sequence is RNA/DNA hybrid, wherein N = T
uaucccaggagcauaggucnn

SEQ ID NO: 388 - DNA, 21 bp, Artificial Sequence
  Synthetic
  misc_feature (20)..(21): Sequence is RNA/DNA hybrid, wherein N = T
gucaucaagcgacgcuucann

SEQ ID NO: 389 - DNA, 21 bp, Artificial Sequence
  Synthetic
  misc_feature (20)..(21): Sequence is RNA/DNA hybrid, wherein N = T
ugaagcgucgcuugaugacnn

SEQ ID NO: 390 - DNA, 21 bp, Artificial Sequence
  Synthetic
  misc_feature (20)..(21): Sequence is RNA/DNA hybrid, wherein N = T
cucucuauggauugcccuunn

SEQ ID NO: 391 - DNA, 21 bp, Artificial Sequence
  Synthetic
  misc_feature (20)..(21): Sequence is RNA/DNA hybrid, wherein N = T
aagggcaauccauagagagnn

SEQ ID NO: 392 - DNA, 21 bp, Artificial Sequence
  Synthetic
  misc_feature (20)..(21): Sequence is RNA/DNA hybrid, wherein N = T
cgcauugagggcauccucann

SEQ ID NO: 393 - DNA, 21 bp, Artificial Sequence
  Synthetic
  misc_feature (20)..(21): Sequence is RNA/DNA hybrid, wherein N = T
ugaggaugcccucaaugcgnn

SEQ ID NO: 394 - DNA, 21 bp, Artificial Sequence
  Synthetic
  misc_feature (20)..(21): Sequence is RNA/DNA hybrid, wherein N = T
gccuuugccgagugcuguann

SEQ ID NO: 395 - DNA, 21 bp, Artificial Sequence
  Synthetic
  misc_feature (20)..(21): Sequence is RNA/DNA hybrid, wherein N = T
uacagcacucggcaaaggcnn

SEQ ID NO: 396 - DNA, 21 bp, Artificial Sequence
  Synthetic
  misc_feature (20)..(21): Sequence is RNA/DNA hybrid, wherein N = T
cuuuccgccuggcagcagann

SEQ ID NO: 397 - DNA, 21 bp, Artificial Sequence
  Synthetic
  misc_feature (20)..(21): Sequence is RNA/DNA hybrid, wherein N = T
ucugcugccaggcggaaagnn

SEQ ID NO: 398 - DNA, 21 bp, Artificial Sequence
  Synthetic
  misc_feature (20)..(21): Sequence is RNA/DNA hybrid, wherein N = T
ggccuuuccaggugaucaann

SEQ ID NO: 399 - DNA, 21 bp, Artificial Sequence
  Synthetic
  misc_feature (20)..(21): Sequence is RNA/DNA hybrid, wherein N = T
uugaucaccuggaaaggccnn

SEQ ID NO: 400 - DNA, 21 bp, Artificial Sequence
  Synthetic
  misc_feature (20)..(21): Sequence is RNA/DNA hybrid, wherein N = T
ccgagaaggacgaguuugann

SEQ ID NO: 401 - DNA, 21 bp, Artificial Sequence
  Synthetic
  misc_feature (20)..(21): Sequence is RNA/DNA hybrid, wherein N = T
ucaaacucguccuucucggnn

SEQ ID NO: 402 - DNA, 21 bp, Artificial Sequence
  Synthetic
  misc_feature (20)..(21): Sequence is RNA/DNA hybrid, wherein N = T
cgcagaacaccguguuugann

SEQ ID NO: 403 - DNA, 21 bp, Artificial Sequence
  Synthetic
  misc_feature (20)..(21): Sequence is RNA/DNA hybrid, wherein N = T
ucaaacacgguguucugcgnn

SEQ ID NO: 404 - DNA, 21 bp, Artificial Sequence
  Synthetic
  misc_feature (20)..(21): Sequence is RNA/DNA hybrid, wherein N = T
cagguguugccgugcuaaunn

SEQ ID NO: 405 - DNA, 21 bp, Artificial Sequence
  Synthetic
  misc_feature (20)..(21): Sequence is RNA/DNA hybrid, wherein N = T
auuagcacggcaacaccugnn

SEQ ID NO: 406 - DNA, 21 bp, Artificial Sequence
  Synthetic
  misc_feature (20)..(21): Sequence is RNA/DNA hybrid, wherein N = T
guccuauugcuggcucguunn

SEQ ID NO: 407 - DNA, 21 bp, Artificial Sequence
  Synthetic
  misc_feature (20)..(21): Sequence is RNA/DNA hybrid, wherein N = T
aacgagccagcaauaggacnn

SEQ ID NO: 408 - DNA, 21 bp, Artificial Sequence
  Synthetic
  misc_feature (20)..(21): Sequence is RNA/DNA hybrid, wherein N = T
gcaaguacgugggccgcuann

SEQ ID NO: 409 - DNA, 21 bp, Artificial Sequence
  Synthetic
  misc_feature (20)..(21): Sequence is RNA/DNA hybrid, wherein N = T
uagcggcccacguacuugcnn

SEQ ID NO: 410 - DNA, 21 bp, Artificial Sequence
  Synthetic
  misc_feature (20)..(21): Sequence is RNA/DNA hybrid, wherein N = T
cacacgcugucagaggaugnn

SEQ ID NO: 411 - DNA, 21 bp, Artificial Sequence
  Synthetic
  misc_feature (20)..(21): Sequence is RNA/DNA hybrid, wherein N = T
cauccucugacagcgugugnn

SEQ ID NO: 412 - DNA, 21 bp, Artificial Sequence
  Synthetic
  misc_feature (20)..(21): Sequence is RNA/DNA hybrid, wherein N = T
ggcgugcucucguuaggcunn

SEQ ID NO: 413 - DNA, 21 bp, Artificial Sequence
  Synthetic
  misc_feature (20)..(21): Sequence is RNA/DNA hybrid, wherein N = T
agccuaacgagagcacgccnn

SEQ ID NO: 414 - DNA, 21 bp, Artificial Sequence
  Synthetic
  misc_feature (20)..(21): Sequence is RNA/DNA hybrid, wherein N = T
gggacaggcuucuccggaann

SEQ ID NO: 415 - DNA, 21 bp, Artificial Sequence
  Synthetic
  misc_feature (20)..(21): Sequence is RNA/DNA hybrid, wherein N = T
uuccggagaagccugucccnn

SEQ ID NO: 416 - DNA, 21 bp, Artificial Sequence
  Synthetic
  misc_feature (20)..(21): Sequence is RNA/DNA hybrid, wherein N = T
caucgaguaccuggugaaann

SEQ ID NO: 417 - DNA, 21 bp, Artificial Sequence
  Synthetic
  misc_feature (20)..(21): Sequence is RNA/DNA hybrid, wherein N = T
uuucaccagguacucgaugnn

SEQ ID NO: 418 - DNA, 21 bp, Artificial Sequence
  Synthetic
  misc_feature (20)..(21): Sequence is RNA/DNA hybrid, wherein N = T
gucuucgcggccgaauccann

SEQ ID NO: 419 - DNA, 21 bp, Artificial Sequence
  Synthetic
  misc_feature (20)..(21): Sequence is RNA/DNA hybrid, wherein N = T
uggauucggccgcgaagacnn

SEQ ID NO: 420 - DNA, 21 bp, Artificial Sequence
  Synthetic
  misc_feature (20)..(21): Sequence is RNA/DNA hybrid, wherein N = T
ccauuucgcccuucucggann

SEQ ID NO: 421 - DNA, 21 bp, Artificial Sequence
  Synthetic
  misc_feature (20)..(21): Sequence is RNA/DNA hybrid, wherein N = T
uccgagaagggcgaaauggnn

SEQ ID NO: 422 - DNA, 21 bp, Artificial Sequence
  Synthetic
  misc_feature (20)..(21): Sequence is RNA/DNA hybrid, wherein N = T
ccuccaucuucauucauagnn

SEQ ID NO: 423 - DNA, 21 bp, Artificial Sequence
  Synthetic
  misc_feature (20)..(21): Sequence is RNA/DNA hybrid, wherein N = T
cuaugaaugaagauggaggnn

SEQ ID NO: 424 - DNA, 21 bp, Artificial Sequence
  Synthetic
  misc_feature (20)..(21): Sequence is RNA/DNA hybrid, wherein N = T
ggacgaagcacuugguaacnn

SEQ ID NO: 425 - DNA, 21 bp, Artificial Sequence
  Synthetic
  misc_feature (20)..(21): Sequence is RNA/DNA hybrid, wherein N = T
guuaccaagugcuucguccnn

SEQ ID NO: 426 - DNA, 21 bp, Artificial Sequence
  Synthetic
  misc_feature (20)..(21): Sequence is RNA/DNA hybrid, wherein N = T
ggcacaucuuccucccgagnn

SEQ ID NO: 427 - DNA, 21 bp, Artificial Sequence
  Synthetic
  misc_feature (20)..(21): Sequence is RNA/DNA hybrid, wherein N = T
cucgggaggaagaugugccnn

SEQ ID NO: 428 - DNA, 1935 bp, Homo sapien
  misc_feature (2)..(2): n is a, c, g, or t
  misc_feature (4)..(4): n is a, c, g, or t
  misc_feature (13)..(14): n is a, c, g, or t
  misc_feature (25)..(25): n is a, c, g, or t
  misc_feature (416)..(416): n is a, c, g, or t
  misc_feature (462)..(462): n is a, c, g, or t
  misc_feature (479)..(479): n is a, c, g, or t
  misc_feature (650)..(650): n is a, c, g, or t
  misc_feature (1379)..(1380): n is a, c, g, or t
  misc_feature (1418)..(1418): n is a, c, g, or t
  misc_feature (1427)..(1427): n is a, c, g, or t
  misc_feature (1439)..(1439): n is a, c, g, or t
  misc_feature (1495)..(1495): n is a, c, g, or t
  misc_feature (1513)..(1513): n is a, c, g, or t
  misc_feature (1621)..(1621): n is a, c, g, or t
  misc_feature (1910)..(1910): n is a, c, g, or t
  misc_feature (1913)..(1913): n is a, c, g, or t
  misc_feature (1933)..(1933): n is a, c, g, or t
tntnttggtgcgnntgggcagtgtncggctggtcctcagtctttgagaggtcttaggcaacatccttagtatagtggaatttctgaggtcaaatttaacatttaatatattctccttttagttcattgaatctgaggttctaaatctgtagcttcattttgagcacaagtctgcattgtcattttttaagagattggcaggcatatccttttgtgatacttaggaaaagactatggatggcagcaaatgaaagtaaaggttctcaactgtgaatgaaatttagaaagataattcttcagcagttggttgattagatgggttagtgcttttggaatatataacagtagacttgtattctttatgcactatacatatgatacgcactgacagaaaagcacagaagacatactgctaanagtttctttgtgcatttcactactgttctaggggactgctgtctcnttggttccttttaggtntgtgttaggatgttgcacaagtaatcatttaatgttaaatgcaagtgtccaaagaaatgagtcttaaagttctttggtcatatttcactttagagttaggacaggagacagctaacctgacttccattttacaaatattagaaactttttcttcagtaacaaaaacagggnaaggacaataaaaccatgaactattttgctttatgtctgtttttaaaaaataattgttttgaagtttgcttattagcttaataccttatagtacttttaaaaaatcatccttggtaattattgacttatcctagatccatgtacaattcagacttttatctgttagctttaataaaaatttaaaaccatctcatttcagaataaaataaacggaattacagttcatgcattagcatttttaagtgaagttctcttaataagattgccttttgtctaaccgaaatagggcatacagattagtttggatgggaaagtggtaagacttgactttttaatactgtgccctatttccaaaaggaagacttgatgtggctttttacattatgctttaaagatgttaatggaggatacatagtcttaaaacaatttgtttgggagtaagttttagtcggaaaaaggtgaagatatttatgctgagttatgttaagcaaattattttgagaccttttgctggtagacaaaaactgaggaaatgtttcactaaatatattatggtcaatgaaaaaaccagactttagagtaaatgtgataaccaagtagatttgtgaactttatttctttagtaattatttttatcttatgtgaaatgattcaacctttaatttttgcctagattatagcaatgttttgttttaccttatagggcattttaatgcttggagaaagacnntaagtgaatctacttcaagggattctgttcatggtggnatacagttnttggtgctcttntggaaattgtcaaacatttactgatagcagaaaaggaaccccaaaacacctgtagngttcaccttgttataagnacagaaacatttggaacaggtttcattctgtttctagatttatgttgttgtagttgaacagcaactgtttttttccctcagtgttaacgaaaggataaagactacctntattgttgggtatgactatcaaaggatttccggtgatttcatgtttgtgaattggagtttaaatgtttgcaggattactgtacttccaaagacccactagaatgtacagctgtactctgtactctccactgagaaaatgaacaaaatcctatgtcttaacagttatgctctaactttttgaaagctttttgatgtaaataataggttagaaactaaaagccttttaatacttacaaaatacaatttgaacgatggaaggttgttcagatactggctttctgtaaaaacntcnttgtgttagaaacctgtaanaa

SEQ ID NO: 429 - DNA, 3911 bp, Homo sapien
aacttacatgcttgctgtaactttggatgaatggaaaaagaaactggaatctcccaacagagaaattattattttacacaatccaaagcttatggtgcattaccagccagttgcagggtctgatgattggggttcaacacccatggagcagggtcgaccaagaactgtgaagagaggagttgagaacatctctgttgacattcattgtggagaacctttacaaatagatcacttggtttttgtagtccatgggattggaccagcttgtgatctccgctttcgaagcattgtacagtgtgttaatgattttcgcagtgtttccttgaacttgctacagacacattttaagaaagcccaagaaaatcagcagattgggagggtagaatttcttccagtcaactggcacagtcctttgcattctactggtgtggatgtagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggttcgcttatattgtttgatatcctaacaaatcagaaagattctttgggggatattgacagtgaaaagggttcgctaaatattgtaatggatcaaggagatacacctacactagaggaagatttgaagaaacttcagctctctgaattctttgatatctttgagaaggagaaagtagataaggaagctctggctttatgtacagaccgagatcttcaggaaataggaattcctttaggaccaagaaagaagatattaaactatttcagcaccagaaaaaactcaatgggtattaagagaccagccccgcagcctgcttcaggggcaaacatccccaaagaatctgagttctgcagtagcagtaatactagaaatggtgactatctggatgttggcattgggcaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcacccttttgatcctgtggcctataggattgaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtgaaacagaatttgtcacctgccatttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtagatttttcttcttcattggtcagtttgtcattgtctttgtagttctctttatgataatcctttatacttgctctcagattccacaggcctctgtttatagagtggcaaaggcaggcgagctgtggtttattgtttataaatttttttataaatgttatggtattcaaagccactgacatttaatatttactgaagccattccttagacagcagtggtctttatccctttctggaaagaaaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttcaaatttatgtttactcttcctattggcagaataggtgctatttaagagtaaaccaaaggataagcagagggagtccctataaccaaagatggacagcatagccctggatagccagataaaccactctttgtattaagaaatgtttctttcctagtggtgaggggtgggtaactgtgaaagagctttatatcttgtctattcatggtattatagctgtatattcccaggatgataagcttgattgaaatcctgtatttagtcatatattatttgcgctgcttcatttgtatcatgtgcaatctctagaccaaccctatttttaaactctggtacagcatcattttgtacatattcccagctgcagaactagtatcacttatctcagcaaaagagattgtttgcatggaaagattaatagcactgattagatttctaatattttgcatttttgaaatgtttgttttctacgtgattatatttaaaactttagtaaatactaaaatg

SEQ ID NO: 430 - DNA, 500 bp, Homo sapien
gaatctcatataattattaaaaaaaaaaaacaattaaaacgaaacggcggggcctagctgtgtataaatgatccttgctgaatatcttaaggttttttgtaagaaaaaagaaaaaccaacaaaaaaagcttattttcacattaaaatgaaacctcttttgcaacttaagaattctatggaaaagcagtttttatcatattttgtgtccatgcaccatttttcttaaaatggcttacaaaaaagaatgtaaacaatttgtgatctggccagttgtacttttagctcccagagggagagttggtggtattatgagttgagtaaaaaccatccaggggaacttgagggagcagtctgttgccagtaatgttccttgtgtgccattaaaccacctccagatgagtggaggaacatcactttttaattttttaattgtatttggaattgttgccgtgtactaagaacttgacctaaataaaatcccacaaagtataaaaaaaaaa

SEQ ID NO: 431 - DNA, 2067 bp, Homo sapien
ggacctgtggttgtaaacaggtgtggttacaggtgtggttatgtatctgagtgttgcggtcatactctcctccagtccaatcctgagcatcttcatcttattaattagctgttcgtttctttgtgcactcattcttttatttttacttctttttaatgttatggtatccagttgtttccagtagcagtttcttgaacttctggcctgtactactaactgcagacctccagagtcactggcctttctgtgctctacatattattttaggggccacatcagttgccaagagcaacatacataccgacctggctgaattattgccagtgaaaacaacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaagtaagttgaattcatccattgtcactgattcaccaagtggatgttgcattgtggaatttgcctgagtactgttgtcattctgctcagccaggcacggtcagtttcttggccagggacattgctatgtgctgtgtgcaagctctttagaagagagattggattttcttggcattatcagcactcatgctatttagtctacttctattttgactgactctttaaattagtacaatttttctacttgtcatataactcctggaacaatagtacgggaagccgtgatccttttccctgactcatgattttagtctttttccaaatcgctgttttttttttgtttttttttttttttgctgctccaacgaccagcatgtgttggagcagatctccatggtaagccaaaagtggacttgtcagcctataactactctgcagctgccactaactctacaggcacagtaactacactttatacaggagcacatgccaaagtgcctgggaggtgccaataaaatcaagaaataagaaaactacaaaaaaagatacggtattaaccttggacataattttttttagggaggcagctttcccacttttataaagggggttgtaaatctcaagaggtcatttgttccccatagcagcatatctcatttttaaattgaagcgaattaaataggattttactactcaacattcattatactgttaatctttgctgaaatatatgctaacaaatgttaagcaagggaaactgaagacttagtcatgtggattgttagcagtgatctgcattctgtaaaagaggtactttcccatgatgtaggcatgaagtggtgccagtaagcgtagagcggaaatgttgactttagttaacattgggtttagcatttccagtgcagcattatcagtgggcctttaaaaatacttcgtaagtacattagctttcactttgttgttaaattatagcagactcattatagagaacaagtttgccttgattttgtttaaaatgacttctgctaagcacccagaagataaaattgacatatttttataatataagcatactttttttgtacattgtgttcattcttgaataaaatgagttctgtgttggcttgtagatactaaaaagaaagtattgattttgattcaataaatgttttctttcaaaaaaaaaaaaaaaaaaa

SEQ ID NO: 432 - DNA, 765 bp, Homo sapien
  misc_feature (471)..(471): n is a, c, g, or t
gcagccctggatcctgacttagagaatgatgatttctttgtcagaaagactggggctttccatgcaaatccatatgttctccgagcttttgaagactttagaaagttctctgagcaagatgattctgtagagcgagatataattttacagtgtagagaaggtgaacttgtacttccggatttggaaaaagatgatatgattgttcgccgaatcccagcacagaagaaagaagtgccgctgtctggggccccagatagataccacccagtcccttttcccgaaccctggactcttcctccagaaattcaagcaaaatttctctgtgtacttgaaaggacatgcccatccaaagaaaaaagtaatagctgtagaatattagttccttcatatcggcagaagaaagatgacatgctgacacgtaagattcagtcctggaaactgggaactaccgtgcctcccatcagtttcacncctggcccctgcagtgaggctgacttgaagagatgggaggccatccgggaggccagcagactcaggcacaagaaaaggctgatggtggagagactctttcaaaagatttatggtgagaatgggagtaagtccatgagtgatgtcagcgcagaagatgttcaaaacttgcgtcagctgcgttacgaggagatgcagaaaataaaatcacaattaaaagaacaagatcagaaatggcaggatgaccttgcaaaatggaaagatcgtcgaaaaagttacacttcagatctgcagaag

SEQ ID NO: 433 - DNA, 1198 bp, Homo sapien
aaaatcaagaatataaaccacattccaggctgctgttttctctccatctacaggccacacttttactgtatttcttcatacttgaaattcattctgctattttcatatcagggtacagacttataagggtgcatgttccttaaaggtgcataattattcttattccgtttgcttatattgctacagaatgctctgttttggtgctttgagttctgcagacccaagaagcagtgtggaaattcactgcctgggacacagtcttataagaatgttggcaggtgactttgtatcagatgttgcttctcttttctctgtacacagattgagagttaccacagtggcctgtcgggtccaccctgtgggtgcagcacagctctctgaaagcaagaaccttcctacctattctaacgtttttgccctctaagaaaaatggcctcaggtatggtatagacatagcaagaggggaagggctgtctcactctagcaaccatccctccattacacacagaaagccctcttgaggcaaaagaagaagaaagaaagaaagcttatctctaaggctactgtcttcagaatgctctgagctgaatgctcttgctcctttcccaagaggcagatgaaaatatagccagtttatctatacccttcctatctgaggaggagaatagaaaagtagggtaaatatgtaacgtaaaatatgtcattcaaggaccaccaaaactttaagtaccctatcattaaaaatctggttttaaaagtagctcaagtaagggatgctttgtgacccagggtttctgaagtcagatagccattcttacctgccccttactctgacttattgggaaagggagaactgcagtggtgtttctgttgcagtggcaaaggtaacatgtcagaaaattcagagggttgcataccaataatcctttggaaactggatgtcttactgggtgctagaatgaaaatgtaggtatttattgtcagatgatgaagttcattgtttttttcaaaattggtgttgaaatatcactgtccaatgtgttcacttatgtgaaagctaaattgaatgaggcaaaaagagcaaatagtttgtatatttgtaataccttttgtatttcttacaataaaaatattggtagcaaataaaaataataaaaacaataactttaaactgcaaaaaaaaaaaaaaaaaaaaaaa

SEQ ID NO: 434 - DNA, 2402 bp, Homo sapien
taacaaatggtctctcgcccggttctgtcccttatttttagattgttttcctgcatcttacaatttccttttttttcaaagttcctttctccaggcctgtttttcagtgctcaggacacggttttcatcacatacttactgtttttttggttgggttttgatacgaaaagctgctacgtttggtgaccagagggagggtttggaatctgtgctttgcaggggatctcggtgggtaccgtggcccctcgcagggtggcgagtggggtccgttcctcgagaagggggcccttacccacaccgtgcggcttgaattctgtcggagttgaatctgtggaaaggattgtcccattagagctgctgcgtcctttcctctgtcctccctgtcacccaaaccccgaagtcacagctgcttagaagaatgggattttggggatacaaccacacacatttccctctggactgaaattttaaaaacagacccatttcactgacttctttagggaaaatagtttcagtcttgggttgtcttgtgagcccacgggcatgggaccctgtctctgctgggcttttccggccccgtcccagctcctcctcaggcagaggctgcagccctcagttctgctgctggatggaacatttcaaccccctccgggaaggtgggcagggtggagggcccagggctaggcctgccatgcaccatgagcaggggtgctacctgggtgtgtgaagttgggctggcttttcctggaggtgggtgagaaggctctccgggcaaatcagaaggccacgagagagagaggagcggggagagtggtgaggaggattcatctctgactgatgaacctcgccgtgcctgtctgtcacatccaagtctgtgccagctgctgggaggtcagactcctgccctgagaaacagcccagtccttggagaatgaaaccctgagggtcagtgagtggaggccttccctcggggccagccattcccgggaggcctgagtgtgacctggaagctctgtgggtcaccaagactggcattttccttgtatttttgtgcagggctgaagtgagcgttcctcctctgaattggtgaggctttggaatttttttgtttcttttactcatcctaatggctggttttggctgcccggagtatcagagaatatcactaagagggcagtcagtttatttttaggcatctttctttctgtccagggagaaacccctcggaagaatcttagtcactctttgcacctgccctgtcattctcgccatggggagaatgcgttgaaaagaaaaataccggggccagggagaagccgtgaatgcatttatttgctttggtgaagctgctgaacactggctgcggagggcccccggcccccatcccgcttcaggccccagtgacccagttgcgtcttaagttccgtcgtccagatttcaggccaccagaggctgccaaaggtggctgaagcagtctccaagtcactctgtctcaaaaataataatcaaatcaagtattttaagtttggctcttctttttttcaagaaaggcttttcggatacctagaataccttcatgtatgtggcttgatttctgtttcaggaaaaggggggcgggaggagagacaacagccgtgttccagagtctgtcctgagatgtcgctgagtccagacacttgggctgcacgtgccctgcagatgacaaaggccggcagctcagcacacgtgcaggaggggttaaagccaatattgagtttttgttcttgttgttttaatctgaacgattattctcctgtaaaaataatttgggaggggcgggtgttgttcggtgtgtgtgtgtgtgtgtgtgtgtgtgtgtgtgtgtatttttttttttacagtggcgcctgtctaaagtatttttcacaacatgtttgataatcagtgctttaaaaagcagcagtgtcctatgaagtggagatgtcagttctagagcattggatgtgaagttctggtcatgtcaccttgcgtgtctcaccctggaggagtgaaggtgggcgcccggcgggggggtgtggctgcaccccagcaccgggagggggcacgcacgacaccagaggaagggacagccccacccatgtcaacagcaggcgacctgtgttttcatttcaagtgggatacagtatttttttaaggagccatacttttttttaagagtttgagatctgaatgtgatttctaattgtatcagacgttaatgttttaaagctataacaaagtttaaaatttctactttttgtttttcatttattttaactgttcttttatctattaaattgttgtatgtggatggggaagttttgtttctcctcttagcatttgtttctataaccagaaataaaattctatattaaagaaatgac

SEQ ID NO: 435 - DNA, 4870 bp, Homo sapien
gtttaaggagatcaacaacgcgcacgccatcctcacggacgccacaaaaaggaacatctacgacaagtacggctcgctgggtctctacgtggccgagcagtttggggaagagaacgtgaacacctacttcgtgctgtccagctggtgggccaaggccctgtttgtcttctgcggcctcctcacgtgctgctactgctgctgctgtctgtgctgctgcttcaactgctgctgcgggaagtgtaagcccaaggcgcctgaaggcgaggagacggagttctacgtgtcccccgaggatctggaggcgcagctgcagtctgacgagagggaggccacagacacgccgatcgtcatacagccggcatccgccaccgagaccacccagctcacagccgactcccaccccagctaccacactgacgggttcaactaaatccaggaggagctgtggtcagaggaggagccggcgcctggccacgccaaccttagaatcatgaactgtagtcacagagatgggaaggcagcctcctgcctgccctggccttgctggggcccctcctgcctccacgcccacccagcgtcgacccttgacccacgaagtgcgtagcatgcagtatttaaagcagtgtagctacggtcttctgtttttttcccttttttaatagcatgtatggggttctgttccatgtctgtgttgtggacattccgcggcatgaccgcgtgaactgcacggtggagctgcctcagggctgtcggtcaggttggtccagtgaggggtgactgcagccggtcaggtgggcgaggagaaggggggctgcccctttcctacctgtgcttgaggggccggaggcaggtgctgcctggcagagctgtgttaccgtcttggcctcggggtctggtccacactctgtgctcccagccttgaggctgcagtaggactctgatctcacctgccagaagagaggcggggccgcgtcctcctggcgtcaccggcgtcactgtcattccttggtgtctgtgctgggcatggttggcttgggggtctgtggtttcctgggccttgtggcagggtttctcccgtgggagaatttggtgtggaaagcataggaggccccttccgaggttgacaccgtgtcctccgcggtgtttctcgcctggtcgtctcgtcgtgtggacgctgccgttctggttctcggaggtgtgtccttcgccgtgttggggttatttgtctgtgttcctgcacttttcccgggctctgagctggattgatggggccagtctcccccctcccatcttgaggtcgttctccacattccttccagcacacctgtcctttccatagccctttttggacctttagaaccacagatgataggaccagcccaatgagccacagtcagagagtagattgtgcatgtgtgagcacccagctactggggacgggggctctcccacgacccctcctcctgtgtttgccagagctcccatctgccccactcgcctttgccccgtcatcgatgattcaggcagagccagatgcgttaggtccctggaggaaggactgactggaccagagggaccctctggctcaggagggttgggtccctgggaggccggcagccaggccacagaatccacacgtggaccattgtgggtccctgggaggccggcagccaggccacggaatccacacgtggaccattgtgggtcccttgggaggccagcagccagactacggaatccacatgtggaccatgggaagtcagtctcttgcgtgtcctagaccttgtgggtggcgccctgcataggggagcagggggaacgggtctgatgtccctgtgctggctgagggctcagagctgcccgcactccgtagctcatgggatgtgctgggcctgcctttggcgccatgctgcagactccagtgggcctggtttctgcagaatgtccatggtggccgctgcagagttgcagaggtccctgtagagataaagctgaggaggaggctgtgtgtgatggctctggctcggaccaaccagatgagcctcctgaagcccccttccctgcctgcctgctgacccgtggccccagctcactcattgccctcagcagccacccgaggctgtgcagaagggtaggttcaggttgaccaggaagctgccaaaagggacatggatatgaggatacatctggacgtgcttaggaacagggtgctggttgagggcccccagctgacccctactgcagatccgcatgtggaccatgagccggctgccagcactaggtcctgggcagctttgtttgtcccacttttctttgtttcttctcactaaaatgatcacgaagacctttgacaagaggagagatatgcactgtgatattaaattagaaataatttatcaaaatcagacctctcctaaaagaataagaaattcattgtttggcccatcctgaaaggtgaggtggcgagacagtggggtgcctccgtgccgcttcgtgcagcagcaagttcagcctgagatgctggctgtactcagcctttgcaatttttgtagatgtagcttaggacgtgagttatttttccgcagactggccaagagccaggttctaagcttggacctaaggtagaaagctgcccatcgggggccctagctcagccccaccaggccctctgttgggcctgcacacagctctgtggctagaacactccaaggcccttcggtacccatcagagtgggccccttgccaggtggcttttcagttacagagtccagtggaccattttgtagaaccatgcagctccctgcggaaggtggggtagggtgggaaagaggagcaggtctggaggtttgtggaacccagtcccctgcagaatctgtaaaacctaataaatcatggttgtggccattctcacggtggtgattgtgattagacgacccccgggaagcccagacactcggggcctggagttcctccccctgcctgacctagaagcagaaccgttttcagcgctctgccctgttggctttaaggctttgtcttaatttaaggaaaaagatcctcccgggttttatttctctctttcttgagtggactgtttccctataattaaaagaggtggtgagtcctggggtagcttccgcgcctccctgtccacgtgctaacagatcaggacgcccccagcacccctgcctgcttttgctggtggcagtgacgggaccccgactcctcactctcgggccgcagacaatgctgtgagcaagtgtggccatgggcacagaatgtccctttggacgccgctgctgggggctgccaggggccctctggggtcgtgctttgaggcccgtccggttcacgagggggtccgggcagcactgactgcttccgacctgcaggaggcgtaggagcggccctgcgggccctttcacggcagctgctgctgtatagatttgtctccactcagtgacgtgggatttttttgtcttccttttggctttatttttaaactgctttagatattactgctcagtgtttgtgaactttcctagttctctatgttgttagtgcagccagcacccagtggggacctactagaaaaaggaactggcatgcacacgtgcccagcaggaaaagcttcgtcttcacgtcggctgctgccatccagaagaggccctggagcctcacgccgtcgaggctgctctcaggcgttctgttccgggcgaggcttgtgctgcaaggaagggcaccagcatgcaggctgccactggagggtccgggtgctgcgggcagagttcagcgcttgtccaccctcccttagctctgactcagtgcatcctactgtggggacatctcgtgaggggacacgaaatgactgatctcaccctttcccagtattcagagctgtgaacccctgtggcgcaggactggcctgtgtctgttattttggttgtaaatcattctcctgtggaattggcaaaagctacatttttactgtccttaccagcaacagtttgcgtcgtcacatgctgtgagtgtgggctgtggtgtgtccgtgtgtgtacatatgtgtatatgtatatatcacgcagcaggagtgtcattcatgctgctgtcccctggtgaagtgacaagtacaattaaaggtggctctgaaatggcctctggtttcttgggagtcgggcagggacctgcaggaggctttcccagcaggtgcacagaaggaagcgctgagcccactgtgtgcagagggtgtgtgcccagggcactgccacggcccccaccagcattggcctctgctctgcagggtggggtgcccatcctgggggctgtgtgtcatgctcacctgacccaggtgtgtgtcccggtgtgaaatcgaggaggggactggaagcccttccctgccttgaaacatgaaagctgattttctgagcagcagatacggtcagtggcaaagctgcatctgaagggcggcctgggaaggggccctgtgctggccccgggtcggccccagaggagtccacacagcaccacctccagaaggggctgggcccggggtcctgcaggcggcaccttttggtagagtttgtttccctggaaaatggggaaaatgtttcaagccaggtgaggggggaagttaacactgaaatatgtattgtttttaaaaatcaaatgcacacgcatggaagctgcttgtccatgcactggttttgtcactggcgtcctggaatccgaccgtgttggggtgcaggcgctgtcagactccggctgatcctggctcgagcacacacatctaagggccaggctggttccgcatggtgatctccgtcttgtatgtctgaatgttggcctaaaataaagattactgttgtaaaat

SEQ ID NO: 436 - DNA, 3682 bp, Homo sapien
cggggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcggaaaggcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggagaatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattcccagtagtgacttcacctcagcctggagcaccaaccaccacctggctagcatatttgacttcacgctggatgaaattcaaagtttaaaaagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtggtagtggtgggagggaaaccatgtcttgctaaacctgtttctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcattcggttccctcaaagggaagcccttgctagtgggggtttgaaagagaatttttggaaccaacattcaaattctgcctcatctggagggaaaccaaaattgggagggggaagaggacccctgatgttttgctgcttccagagatattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcggggcagcaggcctgcaggagctgtttttccattgctaggcctgacccctctctacctgtgagcgttcagggggtccctgagatagtttagatgccccccccatcttagacctcagctcccacagtgccttttaagggggacctcacctcctgtgcacagcccacccactttcctctgcttccctggcacagcccaggcatagacgagctggcgttggacccagttcttcccccttttcagccccacagctgctgccacaggggccaactagggccaggtggaaggggagctgagaagccaacccctagcccaggggtgctgtgggaactgggatccaatttgtagcttcccgcctggcttcagagagcccagcaaccttctaggcctgctttccagacttctgagatagcctgggatgagcaatcctgttacagtacatctggaccttccctacctgggctctggggaggctgtgggcctggagagggaaaaggagggagggggtgtctgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgtaaagttaaaaaaaaaa

SEQ ID NO: 437 - DNA, 3030 bp, Homo sapien
ccccaattcccctcgaagatccaagtcattaaaacacaaaaatggggaacttagcaattcggatccttttaagtataacaattcaactgggatcagctatgagaccctggggccggaggagcttcgcagcctgctaaccacgcaatgtggggtgatttctgaacacaccaagaagatgtgcacaaggtccctgcgctgcccacagcacacagatgagcagaggcgaaccgtacggatttattttctcgggccctcggctgtccttccagaggtcgagagctccctggataatgacagctttgacatgactgacagccaggccctgatcagccggcttcagtgggacggctcctctgacctctcaccctctgattcaggctcctccaagacgagtgaaaatcagggatggggtctaggtaccaacagctctgagtcacggaaaaccaagaaaaagaaatcccatctgagcctggtagggactgcctccggcctaggttccaacaagaagaagaagccaaagccaccggcacccccgacgcccagcatctatgatgacatcaactgacttgggtgcaagggatagcctttggctgagcagagccctctctcctgacccccacccaggtggcatagcctggcaaatggacggctgctgggggttggggcttgggaagcttggtgggccaggcaggcagaggatccgattatgcgcccctggggggtgtcaaagtcctctgcaatggagcacgactcctcggcgtgcaggactcagacctggacatattatgccttggacataagtttggtggggaggcggttttcctatttattctgtgagttactggatgtccagctaggccaggggcctgacctgggcactgtgccaagcactgcctgccccccaccccaggaactggactaagccctgctgaggggcaatgtggcgacccgggaggctgtgggttggaagctgagcctggagggggcctgcctcggccgccctcagcaatgtgaatgggtccggtgcttggagctgaggggcaaggctgggcatgtcctgtctgtgtgcagaatcttatcaaatgcccccagtcccaggggtaggcaggcacagagtgctgtctgctgaggtgggcgtccagaactgccgccaccttccctgcccctcacaggggcagccctttcccctcagtccccatgggcctccttggcagcaggagctgtccttttgttgggtgccaggaaagggcctccagcctctacagcttcaaggaatgggaaagggagggtaggaagagggagaagtgtcagaattcctccccctgcctctcctccctgacccagggctggtgaggagtggggccccaaggtgagagggaacggtgctgctttatttgaaatgttttcttacctcattccctgccccaggaagggacccagcctcaccctcctggggtggccccgtgttcctcctgcccaccctgccccactgccctaccggggcagcccaggttcccaactgctgcttccacccccttcaccttgactggcttcagttcctctcagcgctcctgcctccaaagcgtgccctgtttcccttccttagcgcttttaagttatttattctgtacttgtggtttggggctctgaggaaaatcctaatcttgtgcctctccccctttgctaggagttgggtgggaagagagggtggcctctgtgccccaggttgtcagtggaggggaaggggtgtcactgcccctctgtgggactgtcatgccagtgtgcccacctgcctggtctacatcctaaagagatgtaccgtcccccctccatgcgggcaccaccactcccaggagccaagctggaggaccgcgacctgggctgggagcagagctgactgacatgggtggaggtgaccctgagccaagttctctggcacttgctggacatgtcccctaccctcttcccaagaggagccatcccacatttgggtagttagtacccaggactggttggactgatcgggttagggaccctagagggttaagggaacaacagagatggggctgcaatgcctgtctggaactccgctctcccgctggggtggttctgattgtggctcatgcctggttgcaaattggtttttaacccacaaattgtgattattttttaaaaagccaaacagattttggcaggagttagaataaatcccggggcctgggcttctctattcttggccctccgtagtctccctccgagaggaggccagagggagaggaggatctcagcaggcctctagccgcttccagatgcagtctggggagtgggctgaaggtgaagggaggaaggctgtgggccactctcccttctgagaggcagctgcagctcaggccctaatacactctttgccctgtggcctctcccttttccccccttctggttggaggagggagaagtgggaagtagcttgggaactggtttgtccacataaacttccccattgttccttggcccgccctcagggcagagcccactgcccaggctgggtaaagagatgggcttggtccagcagggaccctgagggaacaaacccttttccttctggggagagagtgccccccctaccatgtagttgaacaggggctaggagctccccactcccctccctctaacagcaggctgtgtgggtttcaattcccatccttcccaccccggctaggtgtcgtccaccctgtatcctgtgtctgagtgtgtgtgggggggttctgtactaatttccatggccggtggcttttccttccatgcatcactcccccccgcatgcccaggggccacccgcctggcattaccgcatgctggggtcattgggggaggggggtggggctcacgctgtcctgtggtcttgagatttttatttttgcatatgtaatccattctgtacaggtagctaactttgtaaacgctgtgtattccctctgcccccatggctgctggtgtaaataaactgcatctcccgttggcaaaaaaaaa

SEQ ID NO: 438 - DNA, 6335 bp, Homo sapien
ctcgtggggaaaaggcagggagggggtggtgtccccagccggtttggggggtgcgttgcccggagacggaaagtttgggagcccgagcaggctcggctgcagcctcggggagggggtccagcgggtggcggccctggggatggggaaggagcaggagctgctggaggcggcccgcaccgggcacctcccggcggtggagaagctgctgtccgggaagcggctctcctcaggctttgggggcggcggcggcggtggctctgggggcggcggcggcggcagcggcggcggcggcggcggcctcggctcttccagccaccccctctccagtctgctcagcatgtggagagggccaaatgtgaactgtgttgacagcactggctacacacccctgcaccatgctgctttgaatggccataaggatgtggtcgaggttcttctgaggaacgatgcgctgaccaacgtggctgactcaaaaggctgctaccctctgcatttggcagcctggaaaggagatgcccagatagtgcggttgctcatccatcaagggccttcacacaccagagtcaatgaacagaacaatgacaacgagacagccctgcattgtgcagcgcagtatggccacacagaggtggtgaaggtgctcttagaggagctgacggaccccaccatgcgcaacaacaaattcgagacccctttggacctggcagcactgtacgggcgactggaggtggtgaaaatgctccttaatgcacaccccaacctcctgagctgcaacactaagaagcacacccctctgcacttggcagcaaggaatggccacaaagccgtggtccaggtcctcctcgatgctggcatggacagcaactaccagacggagatgggcagtgctttgcatgaggctgctttgtttggcaagaccgatgtggtgcaaatcctgctggctgcaggaactgacgtcaacataaaagataaccatggactgactgccctagacactgttcgggaactgccttctcaaaagagccagcaaatagcagcattaattgaagatcacatgactggaaaaagaagtacaaaagaagtagataaaacccccccaccccagccacctctcatctccagtatggactccatatcacagaagtctcagggtgacgtggagaaagcagtgactgaactgattatagattttgatgcaaatgctgaagaagagggtccctacgaagctctgtataatgccatctcctgccattcgttggacagcatggccagcgggcgatcatctgaccaagactccacgaacaaggaggctgaggcagcaggagtgaaacctgctggagtgaggcctagggaacgtccaccacctccagcaaagccaccgcccgatgaagaggaagaagaccacatagataagaagtattttcccttgacagcttctgaggttctgtccatgagacctaggattcatgggagtgcagcccgggaagaagacgaacacccttatgaactgttgttaacagcagagacaaagaaagtggtgttggtggatggaaaaacaaaagaccacaggcggagcagcagcagccggagccaggactctgcggaggggcaggacgggcaggtcccagagcagttctcaggcctcctccacggctcctccccggtgtgcgaggtggggcaggaccctttccagctgctctgtaccgctggccagagccatccagacgggtccccccagcagggcgcctgccacaaggccagcatgcagctggaggagacgggtgtgcatgctcctggagcctcccagcccagtgccctggaccagagcaagagagtgggctacctcacaggcctgcccaccaccaacagccgctcgcaccctgaaactttgactcacacagcatctccgcaccctggtggtgctgaggaaggagaccggagtggggccaggagccgagcgcctcccactagcaaacccaaagctgaactcaaactcagccgcagcttgtccaagtctgactctgatctcctgacctgctcacccacagaggacgctaccatggggagtcggagtgagtccttatccaactgcagcattgggaagaaaaggctagagaagtcaccctccttcgcctcggagtgggatgagattgagaaaatcatgagttctattggagaagggattgacttttctcaggaacggcagaagatctcaggttcacggacgctggagcagagtgtcggggagtggctggagtcgattgggctgcagcagtatgagagcaagttgcttctgaatggctttgacgatgtccacttcctggggtctaatgtgatggaagagcaggacctgcgggacatcggcatcagcgacccacagcaccggcggaagctgctccaggcggcacgctccctacccaaggtgaaggctctgggttatgacgggaacagcccccctagcgtgccctcctggctggactccctggggctgcaggactacgtccattccttcttgtcaagtggttacagctccattgacaccgtgaagaacctctgggagctagagctcgtcaatgtcctgaaggtccagctgctcggccatcgcaagcgcatcatcgcctccctcgcagacagaccgtacgaggagccgccccagaagccccccagattctcccagctgaggtgccaagatttgctctcccagacgtcatccccactgagtcagaatgattcctgcactgggcggtcggcagatctgctgctgcctccaggggacacaggcaggaggcgccatgacagtctccatgaccctgcggcaccctcccgagcggagcgcttcaggatccaggaggagcaccgtgaggccaagctgaccctgcggcccccaagcctggcagccccctacgccccagtgcagagttggcaacaccagccagagaaactcatcttcgagtcctgtggttatgaagccaattatctgggctccatgctgatcaaagatctgcgagggacagaatccacgcaagacgcctgtgccaagatgcggaaatctacggagcacatgaagaagatccccaccatcatcctgtccatcacatacaaaggtgtcaagttcatcgatgcctccaacaagaacgtcattgcagagcacgagatccggaacatttcctgtgcggcccaggacccggaggacctctgtacctttgcctacatcaccaaggacctgcagaccagccaccactattgccatgtgttcagcaccgtggatgtgaacctgacctacgagatcatcctgacgctggggcaggccttcgaagtggcctatcagttggccctgcaggcccagaagtccagggcgacgggcgcctctgcagctgagatgattgaaacaaaatcttccaaaccggtgcctaagcctcgggtcggcgtgaggaaatccgcactggaaccacctgatatggaccaagatgcccaatcccatgccagtgtctcctgggttgtggaccccaaaccagactctaagcggagcctcagcaccaactgagccactgaggaaccacactgtgctgcggaaacatagacgtgggggcataggctcccgctgccaccaccgccatcgcctcacctgcagctctgaagacccaggcctcacctccgcctgcaggacctcctcttggccacttggcctgggcctgccaccaccacgtcctgcagaacgagccctgccttggctgtggagaagcactccaggccgctagcagatgggactggcattccagagggtcaagaagtgacttgttcagaacacattgtttttaacagaaaaaaaatctttttataaaatgaacttttaacacttggctcaaacctctaggtcatactgccaatctttagacaaatggccatggggcagaggacaggggagctgaggttggttcagaggccagcctgcatagcctctgtcctcaggacggaacttgggtgcagctcagtgggtcggaagagaaggcggtggcctgtgggtgaggggaacggagcaggctcaggcagaattgagtacggtgcgtctgcttttcaaacccaaccatatcagctgctgctctttatgaactgcccaacttcctgtccctttcaggggctagacacaggcttctcgtaagaacacagccttagaggcacctgagcaactcaaaggtttccggtccatttctggggttcccgatgggaaggttcagtggccaaatgaagataagtgtgcagtttctagtgctgggaagtcttagccagcaccagagcgccaggcctctccctggcctcttacctgtcagtgatcggagcactgccctgggctggccggcgccgtactgcctgcgttgtgtcagagaataggaaaagcagctttgtttggggcattaatgcttggagtggggtcagctaaggttgctacttgccaatttgtgatttgtctaatcagcctgtgtgattggggctcattttgattctctgaattatcggtttgacggttacacttggctgctgggcccatccctggcccccggtgtggaaaaggctaaataaggtgacagtgcatcgatgctcccccgcgtggcctttggggcaggctggcatcccggtgcgcctctgcttcttaagctttcctgctgctcgctttgtttttaaaagtaacttgggttgcattcttccctctggactagagtagaaatgcaggggaaactgctgtggatttgagaggcaaagttggctcagctgtgtgcccagttcctcctgtgggcactttagcaggctccgagctttcctggcataggtcaatcaggtcccaggatgaataatccaggcttcagcaacactcctctttcccagccagcaaaggctgtgaatttgaattctttgttggtatgtatgtgcagggagtactgttaggcacattcttaacccatgtggttggccagaaatcagaagtggggctgtgtctctgactggctagaggccaggccttgtgggtttctatctgctaagcacccagcaggttggggcctgggactcagctctctctgcggtagaggcaggccctcctccacttcttggtactaaacgaagatctcgacaccttgcagttttacttcatttcctgcccctttcagggcctgtgaggatgcccatgagctaccgctgtacagttctcggccccggctttcttccaagagttgaccaggaaccctaaagcatccagagtagactgcgctgccactgcgcacatgctggtgcccgtcttcctcctaaggggccaggccacatccaagtgggcctctgtcgggggcggggcggtaggtccgaaagaaaccgcagacactacgatgcactcctcaagctgtcttttgtgcttagatcatccataggtgtttcttctgcttgaagctgctatatcatctttatttattcagggtattttcatattggaagccttggctagtctgctctagctctgggttctgtttagagattggtttatttctgaatattcaagaaaggaaaatgactgggcctttctttcttttcttctcctctgggatgggtagtctccctttcctagaaaggttattataactttaaggacaggcttcaagtgggaaggcccctacttttgcacttctccaagtgcaggtcacaccaggggcagaccctgtcgctgcgtttctgaactgtgaaggagcccattcgggtgggagacttcagatgggctcagtacctgtcccagccacaggcttcttgtccacctcttctcccctgcccaccagctgctcagcgcataagaccttcccgacaggctctgcgtgtgcagctctctgcgtccctcctgggccctccagcgtcagacactaatgggagttcccgagatgctcgggtttgagcagggagcaggcagagctgcagtcagagacattagaaaaccagtctgaattgggtctgtctttgagatgcccaggccagcagaaagcagctcagaagtattgttgctcatggtgtggcaatggactgaactgtaatgaaaatgttatttaatctttgtctctgtattttgatacttgaatgactttcccttttgttttactgtatataaaattgttaatctgtctgattttgtctgaattataaacactttgaggtaccaaacataaccaatctgtgcaacaacatagactgacctcagtacccaagagagtgtaaatatttctgggcttccagctttggttttgttattttcataactgtacacaacttagaacagactgaattaataaatgagaagcgacatg

SEQ ID NO: 439 - DNA, 2609 bp, Homo sapien
cgcccgggcaggtctcccttcaaacgtggcgtcgtgggttgtttgcgcctcgcctggggtcagcgagcaaggacgggcgcgggcggggatactcaaagccaacagctggagtcagccctcgtgtcccgggctcacagtggcacgactgaatcctcagagtcggctggcttttgagctctcacgattggggaggagggggcgtttctggttcgcagctccagaggattgcgttccttcccccatacctgtcccccacagtcacgctctgccctgacgtgcagcatttgacaagttaccccctcgccacatactacttccacccacgtccgagttaactttgttcttaaccttcttgagactaccctcggcctccaggtctttttttcccagttcatttttgcccataagattgagtttcgagtttcagatatcatgcagaaagtttacctttaagactgagcacccatctgatactcttcctcccgaaaaagttcatgctcacgagagagtttgtgggaaaagtgaaagccagtacacgcaggaaactatggctgagcacggggctcacttcacagctgcttctgtggccgatgaccagccatccatctttgaggtggtagcacaggacagtttaatgacagcagtgagacccgctcttcagcatgtggtcaaggttcttgcagaatcaaatcccacccactatggcttcttgtggaggtggtttgatgaaatctttactctgctagatcttctgctccagcaacattatctgtctagaaccagtgcctcattttctgaaaacttttacggcttaaagagaattgtaatgggggacactcacaagtctcagagattggctagtgctggtctcccaaagcagcagctttggaaatctattatgttcctggttcttcttccctatctgaaagtgaagctggagaagctggtttctagcctgagagaagaggatgaatattctattcatcccccttcttcccgctggaaacgattttacagagctttcctggcagcctacccatttgtgaacatggcctgggaaggatggtttcttgtacaacaacttcgatacatcctaggaaaagctcagcatcactcaccactgctgaggctggctggagttcagctaggtcgactgacagttcaggatatacaagctctggagcacaaaccagctaaggccagcatgatgcagcaaccagccaggagtgttagtgagaagataaactcagctctgaagaaagctgttgggggtgttgccttatccctgtctactggcctttctgtgggtgtattcttcttgcagttccttgactggtggtactcatctgaaaatcaagaaaccatcaagtcattgactgccctgcctactccaccaccacctgtacacctagactataactctgattctcccctcttacccaaaatgaagactgtgtgcccactgtgtcgtaaaacccgggtgaatgatactgttcttgccacctctggctatgtgttttgttaccgctgtgtgtttcattatgtgaggagtcaccaagcttgtcccatcacaggttatccaacagaagtacaacatctgattaaactctactcccctgagaactgaaagggaatcatgtcttatcctcacaacaaaagtattgcgctgtaatgtcacagagctggtttcagcatggtattgagttgacacttctcagcctcaattcataactatatgaactttaaatgattatatggatttctttaaaaggatatgcccatttgatcctaaccttttagcctgctctctagaaccctacttacagttgaccaagctgcttaaagtagaaggatcaggactggcaggggatatgagggccagtgtagagattaaacagaataatgagtacacaagtttttgcctatccctttccttaaaatataagaaataaaggagctcttacgaaaaacccaggttagaccgcataaaaaataaagtgaacagtgaggtggtagcaagacttctttttagaaaagaaagcatttacctgcctgtctgtaaggtggaaatttcatcagtttgcaaacgataagaaatgcagacttgctcttgatagaaatgcttagaaacactctgggggggaaaaaagctccttccatatactgtgagacatttgttaagtgacatctattgtttatcagcttttaaggataaaaaaggtattttaaaagttggatatttaggatatttgaggatattcctttatgagctctccatatccttcttgagaaactggttaaaaaaggaataggggtagagtgttacagagagtagtctgaagattcctgtgtaaaagcaaagctaacaagcaatgaagacatgaagcaaaatactaatctaattgtgtaaagaaaggatattttaataagttctttctgcttgctgctaagagtttgctaaagtgtcatgaattattctggttattactaaagtttctatgaaacaagtagattttaagaataaatgtttctggaaaaggactatgttatgattttgtagaaatgtaaagattacttgaggtgtttaaaataaatttttcattcagact

SEQ ID NO: 440 - DNA, 3804 bp, Homo sapien
ctgtctgagcatttcactgcggagcctgagcgcgcctgcctgggaaaacactgcagcggtgctcggactcctcctgtccagcaggaggcgcggcccggcagctcccgcatgcgcagtgcgctcggtgtcagacggcccggatcccggttaccggcccctcgctcgctgctcgccagcccagactcggccctggcagtggcggctggcgattcggaccgatccgacctgggcggaggtggcccgcgccccgcggcatgagccggtgaccaagctcggggccgagcgggaggcagccgtggccgagccacagggatctgattcctcccagggggatgtcctgcgcctcagggtccggtggtggcctgcggcatcccttgcggtgccagaagccgtgggacgagtgtctttaatgttatagagctactcagagttgctgtttctccttgagatgcttttggagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattctatcgagtcctcaaatgactggaatgtagagaagcgcagcatccgtgatgtgccggttgttaggctgccagccgacagtcccatcccagagcggggggatctcagttgcagaatgcacacgtgttttgatgtctatcgctgtggcttcaacccaaagaacaaaatcaaggtgtatatctatgctctgaaaaagtacgtggatgactttggcgtctctgtcagcaacaccatctcccgggagtataatgaactgctcatggccatctcagacagtgactactacactgatgacatcaaccgggcctgtctgtttgttccctccatcgatgtgcttaaccagaacacactgcgcatcaaggagacagcacaagcgatggcccagctctctaggtgggatcgaggtacgaatcacctgttgttcaacatgttgcctggaggtcccccagattataacacagccctggatgtccccagagacagggccctgttggctggtggcggcttttctacgtggacttaccggcaaggctacgatgtcagcattcctgtctatagtccactgtcagctgaggtggatcttccagagaaaggaccaggtccacggcaatacttcctcctgtcatctcaggtgggtctccatcctgagtacagagaggacctagaagccctccaggtcaaacatggagagtcagtgttagtactcgataaatgcaccaacctctcagagggtgtcctttctgtccgtaagcgctgccacaagcaccaggtcttcgattacccacaggtgctacaggaggctactttctgtgtggttcttcgtggagctcggctgggccaggcagtattgagcgatgtgttacaagctggctgtgtcccggttgtcattgcagactcctatattttgcctttctctgaagttcttgactggaagagagcatctgtggttgtaccagaagaaaagatgtcagatgtgtacagtattttgcagagcatcccccaaagacagattgaagaaatgcagagacaggcccggtggttctgggaagcgtacttccagtcaattaaagccattgccctggccaccctgcagattatcaatgaccggatctatccatatgctgccatctcctatgaagaatggaatgaccctcctgctgtgaagtggggcagcgtgagcaatccactcttcctcccgctgatcccaccacagtctcaagggttcaccgccatagtcctcacctacgaccgagtagagagcctcttccgggtcatcactgaagtgtccaaggtgcccagtctatccaaactacttgtcgtctggaataatcagaataaaaaccctccagaagattctctctggcccaaaatccgggttccattaaaagttgtgaggactgctgaaaacaagttaagtaaccgtttcttcccttatgatgaaatcgagacagaagctgttctggccattgatgatgatatcattatgctgacctctgacgagctgcaatttggttatgaggtctggcgggaatttcctgaccggttggtgggttacccgggtcgtctgcatctctgggaccatgagatgaataagtggaagtatgagtctgagtggacgaatgaagtgtccatggtgctcactggggcagctttttatcacaagtattttaattacctgtatacctacaaaatgcctggggatatcaagaactgggtagatgctcatatgaactgtgaagatattgccatgaacttcctggtggccaacgtcacgggaaaagcagttatcaaggtaaccccacgaaagaaattcaagtgtcctgagtgcacagccatagatgggctttcactagaccaaacacacatggtggagaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattcctttttctactgtgtcttaaacaccaattcctgatagtccaaggaaccacctttctcccttgatatatttaactccgtctttggcctgacaacagtcttctgcccatgtctgggaacacacgccaggaggaatgtctgataccctctgcatcaagcgtaagaaggtcccaaatcataaccattttaagaacagatgactcagaaacctccagaggaatctgtttgcttcctgattagatccagtcaatgttttaaaggtattgtcagagaaaaacagagggtctgtactagccatgcaaggagtcgctctagctggtacccgtaaaagttgtgggaattgtgacccccatcccaaggggatgccaaaatttctctcattcttttggtataaacttaacattagccagggaggttctggctaacgttaaatgctgctatacaactgctttgcaacagttgctggtatatttaaatcattaaatttcagcatttactaatactgcaaaaaaaaaaaaaaaaaa

SEQ ID NO: 441 - DNA, 4103 bp, Homo sapien
ggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccgttgcaaagcacactgtctttctcagcgttctctgcaagtcagtaggtgttagtatggttgcaaagttcactgtctcagcaaagttgaactgggctacctctctacagctgtttcctcagagggaaaaatcttgagaccatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttcc

SEQ ID NO: 442 - DNA, 963 bp, Homo sapien
gacacgaagcctcccgggtggcttacagacgctgccagcatcgccgccgccagaggagaaatgtctgaagtaagacccctctccagagacatcttgatggagaccctcctgtatgagcagctcctggaacccccgaccatggaggttcttggcatgactgactctgaagaggacctggaccctatggaggacttcgattctttggaatgcatggagggcagtgacgcattggccctgcggctggcctgcatcggggacgagatggacgtgagcctcagggccccgcgcctggcccagctctccgaggtggccatgcacagcctgggtctggctttcatctacgaccagactgaggacatcagggatgttcttagaagtttcatggacggtttcaccacacttaaggagaacataatgaggttctggagatccccgaaccccgggtcctgggtgtcctgcgaacaggtgctgctggcgctgctgctgctgctggcgctgctgctgccgctgctcagcgggggcctgcacctgctgctcaagtgaggccccggcggctcagggcggggctggccccacccccatgaccactgccctggaggtggcggcctgctgctgttatctttttaactgttttctcatgatgcctttttatatttaaaccccgagatagtgctggaacactgctgaggttttatactcaggttttttgttttttttttattccagttttcgttttttctaaaagatgaattcctatggctctgcaattgtcaccggttaactgtggcctgtgcccaggaagagccattcactcctgcccctgcccacacggcaggtagcagggggagtgctggtcacacccctgtgtgatatgtgatgccctcggcaaagaatctactggaatagattccgaggagcaggagtgctcaataaaatgttggtttccagcaaaaaaaaaaaaaa

SEQ ID NO: 443 - DNA, 1958 bp, Homo sapien
agcagccggcgcggccgccagcgcggtgtagggggcaggcgcggatcccgccaccgccgcgcgctcggcccgccgactcccggcgccgccgccgccactgccgtcgccgccgccgcctgccgggactggagcgcgccgtccgccgcggacaagaccctggcctcaggccggagcagccccatcatgccgagggagcgcagggagcgggatgcgaaggagcgggacaccatgaaggaggacggcggcgcggagttctcggctcgctccaggaagaggaaggcaaacgtgaccgtttttttgcaggatccagatgaagaaatggccaaaatcgacaggacggcgagggaccagtgtgggagccagccttgggacaataatgcagtctgtgcagacccctgctccctgatccccacacctgacaaagaagatgatgaccgggtttacccaaactcaacgtgcaagcctcggattattgcaccatccagaggctccccgctgcctgtactgagctgggcaaatagagaggaagtctggaaaatcatgttaaacaaggaaaagacatacttaagggatcagcactttcttgagcaacaccctcttctgcagccaaaaatgcgagcaattcttctggattggttaatggaggtgtgtgaagtctataaacttcacagggagaccttttacttggcacaagatttctttgaccggtatatggcgacacaagaaaatgttgtaaaaactcttttacagcttattgggatttcatctttatttattgcagccaaacttgaggaaatctatcctccaaagttgcaccagtttgcgtatgtgacagatggagcttgttcaggagatgaaattctcaccatggaattaatgattatgaaggcccttaagtggcgtttaagtcccctgactattgtgtcctggctgaatgtatacatgcaggttgcatatctaaatgacttacatgaagtgctactgccgcagtatccccagcaaatctttatacagattgcagagctgttggatctctgtgtcctggatgttgactgccttgaatttccttatggtatacttgctgcttcggccttgtatcatttctcgtcatctgaattgatgcaaaaggtttcagggtatcagtggtgcgacatagagaactgtgtcaagtggatggttccatttgccatggttataagggagacggggagctcaaaactgaagcacttcaggggcgtcgctgatgaagatgcacacaacatacagacccacagagacagcttggatttgctggacaaagcccgagcaaagaaagccatgttgtctgaacaaaatagggcttctcctctccccagtgggctcctcaccccgccacagagcggtaagaagcagagcagcgggccggaaatggcgtgaccaccccatccttctccaccaaagacagttgcgcgcctgctccacgttctcttctgtctgttgcagcggaggcgtgcgtttgcttttacagatatctgaatggaagagtgtttcttccacaacagaagtatttctgtggatggcatcaaacagggcaaagtgttttttattgaatgcttataggttttttttaaataagtgggtcaagtacaccagccacctccagacaccagtgcgtgctcccgatgctgctatggaaggtgctacttgacctaagggactcccacaacaacaaaagcttgaagctgtggagggccacggtggcgtggctctcctcgcaggtgttctgggctccgttgtaccaagtggagcaggtggttgcgggcaagcgttgtgcagagcccatagccagctgggcagggggctgccctctccacattatcagttgacagtgtacaatgcctttgatgaactgttttgtaagtgctgctatatctatccattttttaataaagataatactgtttttgagacaaaaaaaa

SEQ ID NO: 444 - DNA, 3277 bp, Homo sapien; identical to SEQ ID NO: 368

SEQ ID NO: 445 - DNA, 2042 bp, Homo sapien
ggggccagtcgttcgccggaaagcatttgtctcccacctcatcataacaacaattaatttcctctggggcctgaggagggcagaatttcaaccttcggtgtgcttgggagtggcgattgtgatttacacgacaaaatgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaaggtttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatatttcttccatgttgatttaattctaagatgaaccaataaagacataattcttgcaaaaaaaaaaaaaaaaaaaaaaaaaa

SEQ ID NO: 446 - DNA, 3031 bp, Homo sapien
ctcagacctgtcagcccgccacactccagccagtcccttccgatcacctccagacaccacgctctcctttcggagcccgcccgccggaagtgacggcccggaactactcccacaggggggcggggaaggaagatggcggcgcccagcgtcccgtgaggagagaggacacagggatcccggggagcggccccagactcgtaaattatggccgcatctccgcacactctctcctcacgcctcctgacaggttgcgtaggaggctctgtctggtatcttgaaagaagaactatacaggactcccctcacaagttcttacatcttctcaggaatgtcaataagcagtggattacatttcagcactttagcttcctcaaacgcatgtatgtcacacagctgaacagaagccacaaccagcaagtaagacccaagccagaaccagtagcatctcctttccttgaaaaaacatcttcaggtcaagccaaagcagaaatatatgagatgagacctctctcaccgcccagcctatctttgtccagaaagccaaatgaaaaggaattgatagaactagagccagactcagtaattgaagactcaatagatgtagggaaagagacaaaagaggaaaagcggtggaaagagatgaagctgcaagtgtatgatttgccaggaattttggctcgactatccaaaatcaaactcacagctctggttgtaagtaccactgcagctggatttgcattggctccgggcccttttgactggccctgtttcctgcttacttctgttgggacaggccttgcatcctgtgctgccaactccatcaatcagttttttgaggtgccatttgactcaaacatgaataggacaaagaacagaccgctggttcgtggacagatcagcccattgctagctgtgtcctttgccacttgttgtgctgttccgggagttgccattctgaccttgggggtgaatccactcacaggagccctggggctcttcaacattttcctgtatacctgctgctacacaccactgaaaaggatcagcattgccaacacatgggtcggagctgtggttggggccatcccgcctgtcatgggctggacagcggccacgggcagcctcgatgctggcgcatttctcctgggaggaatcctctactcctggcagtttcctcatttcaacgccctgagctggggcctccgtgaagactactcccggggcggctactgcatgatgtcggtcacccacccgggcctgtgccggcgcgtggcgctgcgccactgcctggccctgctcgtgctgtccgcagcagcccctgtgctggacatcaccacatggaccttccccatcatggcccttcccatcaatgcgtacatctcctacctcggcttccgcttctacgtggacgcagaccgcaggagctcgcggagactgttcttctgcagcctgtggcacctgccgctgctgctgctgctcatgctcacctgcaagcggccgagcggaggcggggacgcagggccccctcccagctgagagcactgggacgcccaccgcccctttccctccgctgccaggcgagcatgttgtggtaattctggaacacaagaagagaaattgctgggtttagaacaagattataaacgaattcggtgctcagtgatcacttgacagttttttttttttttaaatattacccaaaatgctccccaaataagaaatgcatcagctcagtcagtgaatacaaaaaaggaattatttttccctttgagggtctttatacatctctcctccaaccccaccctctattctgtttcttcctcctcacatgggggtacacatacacagcttcctcttttggttccatccttaccaccacaccacacgcacactccacatgcccagcagagtggcacttggtggccagaaagtgtgagcctcatgatctgctgtctgtagttctgtgagctcaggtccctcaaaggcctcggagcacccccttcctggtgactgagccagggcctgcatttttggttttccccaccccacacattctcaaccatagtccttctaacaataccaatagctaggacccggctgctgtgcactgggactggggattccacatgtttgccttgggagtctcaagctggactgccagcccctgtcctcccttcacccccattgcgtatgagcatttcagaactccaaggagtcacaggcatctttatagttcacgttaacatatagacactgttggaagcagttccttctaaaagggtagccctggacttaataccagccggatacctctggcccccaccccattactgtacctctggagtcactactgtgggtcgccactcctctgctacacagcacggctttttcaaggctgtattgagaagggaagttaggaagaagggtgtgctgggctaaccagcccacagagctcacattcctgtcccttgggtgaaaaatacatgtccatcctgatatctcctgaattcagaaattagcctccacatgtgcaatggctttaagagccagaagcagggttctgggaattttgcaagttatcctgtggccaggtgtggtctcggttaccaaatacggttacctgcagctttttagtcctttgtgctcccacgggtctgcagagtcccatctgcccaaaggtcttgaagcttgacaggatgttttcattactcagtctcccagggcactgctggtccgtagggattcattggtcggggtgggagagttaaacaacatttaaacagagttctctcaaaaatgtctaaagggattgtaggtagataacatccaatcactgtttgcacttatctgaaatcttccctcttggctgcccccaggtatttactgtggagaacattgcataggaatgtctggaaaaagcctctacaacttgttacagccttcacatttgtacaattcattgattctcttttccttccacaataaaatggtatacaagaaaaaaaaaaaaaaaaaaaaaaaaaaaaaaaaa

SEQ ID NO: 447 - DNA, 3082 bp, Homo sapien
agggagtcgtgtcggcgccaccccggcccccgagcccgcagattgcccaccgaagctcgtgtgtgcacccccgatcccgccagccactcgcccctggcctcgcgggccgtgtctccggcatcatgtgtggtatatttgcttacttaaactaccatgttcctcgaacgagacgagaaatcctggagaccctaatcaaaggccttcagagactggagtacagaggatatgattctgctggtgtgggatttgatggaggcaatgataaagattgggaagccaatgcctgcaaaacccagcttattaagaagaaaggaaaagttaaggcactggatgaagaagttcacaagcaacaagatatggatttggatatagaatttgatgtacaccttggaatagctcatacccgttgggcaacacatggagaacccagtcctgtcaatagccacccccagcgctctgataaaaataatgaatttatcgttattcacaatggaatcatcaccaactacaaagacttgaaaaagtttttggaaagcaaaggctatgacttcgaatctgaaacagacacagagacaattgccaagctcgttaagtatatgtatgacaatcgggaaagtcaagataccagctttactaccttggtggagagagttatccaacaattggaaggtgcttttgcacttgtgtttaaaagtgttcattttcccgggcaagcagttggcacaaggcgaggtagccctctgttgattggtgtacggagtgaacataaactttctactgatcacattcctatactctacagaacaggcaaagacaagaaaggaagctgcaatctctctcgtgtggacagcacaacctgccttttcccggtggaagaaaaagcagtggagtattactttgcttctgatgcaagtgctgtcatagaacacaccaatcgcgtcatctttctggaagatgatgatgttgcagcagtagtggatggacgtctttctatccatcgaattaaacgaactgcaggagatcaccccggacgagctgtgcaaacactccagatggaactccagcagatcatgaagggcaacttcagttcatttatgcagaaggaaatatttgagcagccagagtctgtcgtgaacacaatgagaggaagagtcaactttgatgactatactgtgaatttgggtggtttgaaggatcacataaaggagatccagagatgccggcgtttgattcttattgcttgtggaacaagttaccatgctggtgtagcaacacgtcaagttcttgaggagctgactgagttgcctgtgatggtggaactagcaagtgacttcctggacagaaacacaccagtctttcgagatgatgtttgctttttccttagtcaatcaggtgagacagcagatactttgatgggtcttcgttactgtaaggagagaggagctttaactgtggggatcacaaacacagttggcagttccatatcacgggagacagattgtggagttcatattaatgctggtcctgagattggtgtggccagtacaaaggcttataccagccagtttgtatcccttgtgatgtttgcccttatgatgtgtgatgatcggatctccatgcaagaaagacgcaaagagatcatgcttggattgaaacggctgcctgatttgattaaggaagtactgagcatggatgacgaaattcagaaactagcaacagaactttatcatcagaagtcagttctgataatgggacgaggctatcattatgctacttgtcttgaaggggcactgaaaatcaaagaaattacttatatgcactctgaaggcatccttgctggtgaattgaaacatggccctctggctttggtggataaattgatgcctgtgatcatgatcatcatgagagatcacacttatgccaagtgtcagaatgctcttcagcaagtggttgctcggcaggggcggcctgtggtaatttgtgataaggaggatactgagaccattaagaacacaaaaagaacgatcaaggtgccccactcagtggactgcttgcagggcattctcagcgtgatccctttacagttgctggctttccaccttgctgtgctgagaggctatgatgttgatttcccacggaatcttgccaaatctgtgactgtagagtgaggaatatctatacaaaatgtacgaaactgtatgattaagcaacacaagacaccttttgtatttaaaaccttgatttaaaatatcaccccttgaagcctttttttagtaaatccttatttatatatcagttataattattccactcaatatgtgatttttgtgaagttacctcttacattttcccagtaatttgtggaggactttgaataatggaatctatattggaatctgtatcagaaagattctagctattattttctttaaagaatgctgggtgttgcatttctggaccctccacttcaatctgagaagacaatatgtttctaaaaattggtacttgtttcaccatacttcattcagaccagtgaaagagtagtgcatttaattggagtatctaaagccagtggcagtgtatgctcatacttggacagttagggaagggtttgccaagttttaagagaagatgtgatttattttgaaatttgtttctgttttgtttttaaatcaaactgtaaaacttaaaactgaaaaattttattggtaggatttatatctaagtttggttagccttagtttctcagacttgttgtctattatctgtaggtggaagaaatttaggaagcgaaatattacagtagtgcattggtgggtctcaatccttaacatatttgcacaattttatagcacaaactttaaattcaagctgctttggacaactgacaatatgattttaaatttgaagatgggatgtgtacatgttgggtatcctactactttgtgttttcatctcctaaaagtgttttttatttccttgtatctgtagtcttttattttttaaatgactgctgaatgacatattttatcttgttctttaaaatcacaacacagagctgctattaaattaatattgatat

SEQ ID NO: 448 - DNA, 1651 bp, Homo sapien
acagcagttacactgcggcgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaaggcccttttaagggccaccaccgccctcatggaaagagctgagccgcttcagactgcggggcaagcgggccgcggctcccttcccctcccctcccctcgcccgccttcgccgcccggcctcgagtccccgcccgcccccgctcccgtcccgcaccgcctgccgcgtcggcctcgggccctgccctgtccgccgtccgccctccggtagggttcgggccttccggatgcggcttgggcgctcttcggggacctccgtggcgcggaagacccgagcctgccggggggaggccggcggcgccgcacctgcccgcctcggcgttcgtgactcagccgccccatcccgagtcgctaaggggctgcggggaggccgcagcaccttctggaagacttggccttccgctctgacgcagggccgaggtgggcagtccaggccgagaggccggcggccctgaaggtgagtgaggccctcggcagctgcagccggggtgtctggtacccccccggcgtggtgcttagcccaggactttcagacgcggccgctggccgggaggctttggtgggagagacgcgatcgccgatttcggtctggcgccccttctgcggccgggacccaggcctttcacatcagctctccctccatcttcattcataggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgttttttttttaaaaaaaaaaaaaaaaaaaaaaaaaaaaaaaaaaaaaaaaaaaaaaaaaaaaaaaaaaaa

SEQ ID NO: 449 - DNA, 4516 bp, Homo sapien
ctcggcgcgcctggacccctgcccctctctgggtggagaagctcccggccgcttcccggtttcactccttctcagcctgggctcccagcccctctctccttttcctggactggctctcacccccttcggtccccttcctttagctcaggctccctaccccttcctttagcccacagcccagagtcccagctcctcagtcactttcctcagccaaaggtcccagccttccttcttcctttcctttgcactatccctatcctgccccttcctctatccctagggctcagtttcccacatccgtcctcccccttcccaggcccggagttccagaccttttggtctcctttcgtggtcgttcctgggtccttgccccctttccccactttggagttccagattgcaaacccagcctccctccacccccagaaaattgcttccatggaaatgcctctctaaaacatgaacttttcctagagactacgccagtctctcttcccacttgctgaccctttgctacctatgtgcccggttttactctcatttgggtaaggtcgaggctggctctggaagcagcaccatggttctgcggtctggcatctgtggcctctctccacatcggatcttcccttccttactcgtggtggttgctttggtggggctgctgcctgttctcaggagccatggcctccagctcagcccaactgccagcaccattcgaagctcagagccaccacgagaacgctcgattggggatgtcaccaccgctccaccggaggtcaccccagagagccgccctgttaatcattccgtcactgatcatggcatgaagccgcgcaaggcctttccagtcctgggcatcgactacacacacgtgcgcacccccttcgagatctccctctggatccttctggcctgcctcatgaagataggtttccatgtgatccccactatctcaagcatcgtcccggagagctgcctgctgatcgtggtggggctgctggtggggggcctgatcaagggtgtaggcgagacaccccccttcctgcagtccgacgtcttcttcctcttcctgctgccgcccatcatcctggatgcgggctacttcctgccactgcggcagttcacagaaaacctgggcaccatcctgatctttgccgtggtgggcacgctgtggaacgccttcttcctgggcggcctcatgtacgccgtgtgcctggtgggcggtgagcagatcaacaacatcggcctcctggacaacctgctcttcggcagcatcatctcggccgtggaccccgtggcggttctggctgtctttgaggaaattcacatcaatgagctgctgcacatccttgtttttggggagtccttgctcaatgacgccgtcactgtggtcctgtatcacctctttgaggagtttgccaactacgaacacgtgggcatcgtggacatcttcctcggcttcctgagcttcttcgtggtggccctgggcggggtgcttgtgggcgtggtctacggggtcatcgcagccttcacctcccgatttacctcccacatccgggtcatcgagccgctcttcgtcttcctctacagctacatggcctacttgtcagccgagctcttccacctgtcaggcatcatggcgctcatagcctcaggagtggtgatgcgcccctatgtggaggccaacatctcccacaagtcccacaccaccatcaaatacttcctgaagatgtggagcagcgtcagcgagaccctcatcttcatcttcctcggcgtctccacggtggccggctcccaccactggaactggaccttcgtcatcagcaccctgctcttctgcctcatcgcccgcgtgctgggggtgctgggcctgacctggttcatcaacaagttccgtatcgtgaagctgacccccaaggaccagttcatcatcgcctatgggggcctgcgaggggccatcgccttctctctgggctacctcctggacaagaagcacttccccatgtgtgacctgttcctcactgccatcatcactgtcatcttcttcaccgtctttgtgcagggcatgaccattcggcccctggtagacctgttggctgtgaagaaaaagcaagagacgaagcgctccatcaacgaagagatccacacacagttcctggaccaccttctgacaggcatcgaagacatctgtggccactacggtcaccaccactggaaggacaagctcaaccggtttaataagaaatatgtgaagaagtgtctgatagctggcgagcgctccaaggagccccagctcattgccttctaccacaagatggagatgaagcaggccatcgagctggtggagagcgggggcatgggcaagatcccctctgccgtctccaccgtctccatgcagaacatccaccccaagtccctgccttccgagcgcatcctgccagcactgtccaaggacaaggaggaggagatccgcaaaatcctgaggaacaacttgcagaagaccaggcagcggctgcggtcctacaacagacacacgctggtggcagacccctacgaggaagcctggaaccagatgctgctccggaggcagaaggcccggcagctggagcagaagatcaacaactacctgacggtgccagcccacaagctggactcacccaccatgtctcgggcccgcatcggctcagacccactggcctatgagccgaaggaggacctgcctgtcatcaccatcgacccggcttccccgcagtcacccgagtctgtggacctggtgaatgaggagctgaagggcaaagtcttagggttgagccgggatcctgcaaaggtggctgaggaggacgaggacgacgatgggggcatcatgatgcggagcaaggagacttcgtccccaggaaccgacgatgtcttcacccccgcgcccagtgacagccccagctcccagaggatacagcgctgcctcagtgacccaggcccacaccctgagcctggggagggagaaccgttcttccccaaggggcagtaacgccagggccagcaggcagcgcctgtcccctcacagactcttccaccagagcaggggctgctgggggctccccttgcccttcctgacccggattggccctgcccctccccctaccgcatggcagctgggcccacagcccccaccccagcacagctcctcccctgccgcctcccgggaagcatcctccccaccagagctgcctccccaatccatttggcagaactgctggggctggtgaggccggccctgcccctccctagatccaggcttctcccggacctggactagggcctcggaggctcctccctctgcctcatcctcctcctcattcagaccaatcttagtttctaaccaaagagtctctggctcagctgtggtcccacccaggaagggagggagctgaggcctcccttgagtaggccctgctttatcaggggacaaaccaggggtaccaggcacatggctgggggagggactgctgacccaccaaggtctcacactcctcctgccagctctgtcaccctggccaccacccaacctatccttactcagagctgcgggctgagggcatctctgagtgtctctgcctggagcaggggtggtttctacggtgacagtgacgtgactcagagcttttcgaactgtgctcccacggggaccactgggcccctcaggggaagctgctaggggaaggactggccgtggctccagaatgtgctgcctttttaagttttgtttgttcacactcctatatatgattgtttgcacagagggcgctcctgtttttaaaacattttgaaaacccctggctgaacagtgctctgcctctaactccctcctcacactccagaattacccttcctcatctgtgcctgtctgtccaacccctcccccacgtctctctgcctgctgggctcttaactgttgctcgaagactgtgacatcagaagtaactcccactcctaatcaagagtctctccagcctcacagatgctggcctcttggcacctgcctagctcttgggcctgacctccagtcctgctggcctgctcttacttcccccaccctgggtttggcccctggaacctttcccttgtgtgtaccacaccctgcctgctgtggagcccattgtggaggcggtgggggggagaaggcctcccctgaggatcccctgtcccctggggctggtggattgggcagaatcctgggcccccagagacctttgcccacacacactccttccccttgtccctggggcactcccccaggattgtgcaatagtcagagtgtccctttttgcaggggactgggccatgggtcctcggcccatctgtccatcctcctctccatgcaagtgctgtttgggcaggagtcaccatgcaagggtgacatcgacaaccacgtaccaagccaccgcagctgctgccactctgctgcctgtacagaagaaactgaatctttttcatattctaataaatcaatgtgagtttt

SEQ ID NO: 450 - DNA, 2958 bp, Homo sapien
aacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaacaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctgattcgagggactgggtctggggggcagcttcaggatctggactgcagcagctctgatgacgaaggggctgctcaaaactctaccaaacctagtgcgaccaagggaacactgggtggcatgtttggtatgctgaagggccttgtgggttcaaagagcttgagtcgtgaagacatggaatctgtgctggacaagatgcgtgatcatctcattgctaagaacgtggctgcagacattgccgtccagctctgtgaatctgttgccaacaagttggaagggaaggtgatggggacgttcagcacggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttgcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtcaagttcaacagagccttggctgaccattctatggctcagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatttgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaagtagctcagctgcagcgttgcattgggcttcttggcctcccaactcttcccactcccagaatccagaagtaagctctgcatgttccccttcctgggaggaaaccaattgtcagaaggatgtatgatgaccccctcccctcccatccttcacctcctaagcagtcctggcttttcctcatcactcccctctacagtgcctggtagacaagtgctacattgaagaacacaaacctcttgttaagacttgtcctgtagcttgatattacagatgtgctattagtgcaataaggtgaaggctgtctgcccagagaaataagtaatttatataagaaaataaatttcataaataaaaaaaaaaaaaaa

SEQ ID NO: 451 - DNA, 4232 bp, Homo sapien
aaaattgcgtttgagtttgccgcgagccgggccaatcggttttgccaacgcatgcccacgtgctggcgaacaaatgtaaacacggagatcgtgtgccgggcacttggtttcgtggtgggcaactgtgctgctgtttcttttggccgcggacaaggtcggcagaggtggacccctgcttgggagagctcttctcgctgtgctgacacccgcccctaacagtcacccaccccggggaaataatggggctcggaggcctcctcccagccagtgtccagcctaagcacatcggctcccgcagttcagaaaggtcccgaggcccgagtcaccatttccggctcagacctcgacccggaacgtggctgcccactgccacgcccactacgccccagtggctcgccccaggggacgaggggcaagaagcggcctccgagggcagcggccgaaggccattcggtccctggctcttcccagctcgcagagacccggaagcgctgcccggccgcctgcccctcttcagatcccccagcaccggaggagcagcgagggggctgcgtccaggccggctttcgggtcggcttaggcgaatccagctctcttttgcccctcccagaaggcccagccccgtccgggcggtgttcgggcggcgccgggccgggccccccgccgccccaggctcgctcataggcccggaacaccacagcccgcccagacttggctggcgccgagccgggggtggagccagcgggttcccgccaaaatcgcgtagctggtccttcccccgcgggctacgtcgcgccctcctttttttttcaaacccggagctgcactgggattggtggactgggcactcacgtggttaacggtcgcgggaagccgcggagcccgaacctgagactggacctgaggagacctcagcctcggtgctcgggccgccccgcctctgccggaaagtccgcgccgccgctgccgccaccgtccgcagcccgagcgccccggagccgcaggccgccgccgcgcagagacgccgcggctgcgactaggcgcgcccagccgcacgtggcggacccgcccccaggcccgcagtgtcctggaccccgcaggcctccgctctcctgtcctcggccccgtccccagggccgcgatgagcttcctgagccgacagcagccgccgccaccccgccgcgccggggcggcctgcaccttgcggcagaagctgatcttctcgccctgcagcgactgtgaggaggaggaagaagaggaggaggaggagggcagcggccacagcaccggggaggactcggcctttcaagagcccgactcgccgctgccgcccgcgcggagccccacggagcccgggcccgagcgccgccgctcgcccgggccggcccccgggagccccggcgagctggaggaggacctgttgctgcccggcgcctgcccgggcgcggacgaggcgggcggtggggcggagggcgactcgtgggaggaggagggcttcggctcctcgtcgccggtcaagtcgccggcggccccctacttcctgggtagctctttctcgccggtgcgctgcggcggcccaggagatgcgtcgccgcggggttgcggggcgcgccgggcgggcgaaggccgccgctcgccgcggccggaccacccgggcaccccgccacacaagaccttccgcaagctgcgactcttcgacaccccgcacacgcccaagagtttgctctccaaagctcggggaattgattccagctctgttaaactccggggtagttctctcttcatggatacagaaaaatcaggaaaaagggaatttgatgtgcgacagactcctcaagtgaatattaatccttttactccggattctttgttgcttcattcctcaggacagtgtcgtcgtagaaagagaacgtattggaatgattcctgtggtgaagacatggaagccagtgattatgagcttgaagatgaaacaagacctgctaagagaattacaattactgaaagcaatatgaagtcccggtatacaacagaatttcatgagctagagaaaatcggctctggagaatttggttctgtatttaagtgtgtgaagaggctggatggatgcatttatgccattaagcgatcaaaaaagccattggcgggctctgttgatgagcagaacgctttgagagaagtatatgctcatgcagtgcttggacagcattctcatgtagttcgatatttctctgcgtgggcagaagatgatcatatgcttatacagaatgaatattgtaatggtggaagtttagctgatgctataagtgaaaactacagaatcatgagttactttaaagaagcagagttgaaggatctccttttgcaagttggccgaggcttgaggtatattcattcaatgtctttggttcacatggatataaaacctagtaatattttcatatctcgaacctcaatcccaaatgctgcctctgaagaaggagacgaagatgattgggcatccaacaaagttatgtttaaaataggtgatcttgggcatgtaacaaggatctccagtccacaagttgaagagggcgatagtcgttttcttgcaaatgaagttttacaggagaattatacccatctaccaaaagcagatatttttgcgcttgccctcacagtggtatgtgctgctggtgctgaacctcttccgagaaatggagatcaatggcatgaaatcagacagggtagattacctcggataccacaagtgctttcccaagaatttacagagttgctaaaagttatgattcatccagatccagagagaagaccttcagcaatggcactggtaaagcattcagtattgctgtccgcttctagaaagagtgcagaacaattacgaatagaattgaatgccgaaaagttcaaaaattcacttttacaaaaagaactcaagaaagcacagatggcaaaagctgcagctgaggaaagagcactcttcactgaccggatggccactaggtccaccacccagagtaatagaacatctcgacttattggaaagaaaatgaaccgctctgtcagccttactatatactgagctactcctttcccacctccccctgaacactgtgacaagaggaagctaggttgaaatcactgatagaatccagtttgcaattactttctcgattggtgtcagtagttttactgattaggacttttattgtgaattacagttgaaagctgtattttgatgattgctatgtcaggctttcatctaatcttaccagtctgtcttctgtaggatgtgtcactgttggatgttacaccagcctttccagggttaaccactgtggtggtgtgctgcttatagtttgctgttgcattgtaataaaaggtgtctttccctgtagtgacctgtaaaaagtactcaagggctttattacagacataccctccctttgaaaagggacatgctaaaagactcattactactcagccttcaatgtacctgtgtgtccatcttatatttcttttttttttttaattgtgaattagacttgtatatcccactgggagcactttgtaggcattgcatgaaccatgggatgatgattctgtggaggtattgccttgtgaatttgctgctattttagttttgtctttgctgtaaacttgtagcattaaacaatcattgttgttaataggtcttctttttgaaacaattatgtgaaatgtatagctgcttttgatgaaaagcagctatttgccttttttttttttcctttgaactttgaagctagtgcattggaaaaatgcaccctttccctcctttggaatgctgtattaatgtagtataataattactggttttgtaacttgttctggtaatgtccttcccggactctttttaaatgtctccccctaagttttatacttgattgtattattagtctgtttttaaatgttttgcccggtttttctcttcaatatttgtgtatataaaccgatcttcgtgatactgtacatagctgtttgaaatgccagaatgacttctgacattccaagtttttcacaaaatatattttatctgtgattagccatttgactaataatactggctaacagatgttgaaaaaaattgtctgtttgttttctcattaattttggtctaaaacatgtttgcacttgtctttgacttgtgttttattaacattgattggcatattaaaagtcactctgagctt

SEQ ID NO: 452 - DNA, 2711 bp, Homo sapien
gggagagggagctctcgggtcggggctagggaaggctgaccccgctcggcccgggtgaaagggcggtgacggcactgggtggggccgagctccagggctggctgctgggctgctaagggaactgtgagccgctcagagccgcgcgcctcccgggcggggcggggccggccgtgggagtccgcgcgtgcccgcgccgagctgcctgctccggcggcttcgctgctagctcgcggcgacgtcgggccgattttcccaggatgacagagctgaggcagagggtggcccatgagccggttgcgccacccgaggacaaggagtcagagtcagaagcaaaggtagatggagagactgcatcggacagtgagagccgggcagaatccgcacccctgccagtctctgcagatgataccccggaggtcctcaatagggccctttccaacttgtcttcaagatggaagaactggtgggtgagaggcatcctgactttggccatgattgcatttttcttcatcatcatttacctgggaccaatggttttgatgataatcgtgatgtgcgttcagattaagtgtttccatgagataatcactattggctacaacgtctaccactcatatgatctgccctggttcaggacgctcagctggtactttctcctgtgtgtaaactatttcttctatggtgagacagtgacggattacttcttcaccctggtccagagagaagagcctttgcggattctcagtaaataccaccggttcatttcctttactctctatctaataggattctgcatgtttgtactgagtctggtcaagaagcattatcgactgcagttctacatgtttggctggacccatgtgacattgctgattgttgtaacacagtcacatcttgttatccacaacctatttgaaggaatgatctggttcattgtccccatatcttgtgtgatctgtaatgacatcatggcctatatgtttggctttttctttggtcggaccccactcatcaagctgtccccgaagaagacctgggaaggcttcattgggggcttctttgctactgtggtgtttggccttctgctgtcctatgtgatgtccgggtacagatgctttgtctgccctgtggagtacaacaatgacaccaacagcttcactgtggactgtgagccctcggacctgtttcgcctgcaggagtacaacattcctggggtgatccagtcagtcattggctggaaaacggtccggatgtaccccttccagattcacagcatcgctctctccacctttgcctcgctcattggcccctttggaggattcttcgcaagtggattcaaacgagcctttaaaatcaaagactttgccaataccattcctggccatggaggcatcatggatcgctttgactgccagtatctgatggccacctttgtcaatgtatacatcgccagttttatcagaggccctaacccaagcaaactgattcagcagttcctgactttacggccagatcagcagctccacatcttcaacacgctgcggtctcatctgatcgacaaagggatgctgacatccaccacagaggacgagtaggggccacccagggccaggagaacaggaacagaactgagcaggggcaggtctccaaggcaagcccagctggtgtgacttagacaatgacgaggcttcaactcactgtcttttttttttttttttggagggtattttttatttgtgggttcaaaaaatctgtatatacagtctatgtgtttagaatttgtgttgtaagtaaactacagctttgagttggaaagaagtcacgggttgtaaaaccatttggatttttttaaaacaaaagtattaataatctggaagacagtgttgcccaggtcaggagtgttttcttggtggttccagcccccatcaattgaactgtttctgggctcagtcagacacagacattcatctgtgtctgaccaaatcaggggacttccccacctgtggtgggaggcacagcttagatgttttgtacacctggtcttttctagaaatccctgcttggagctgcagaagggttgccttctgtaggtcggaggaatggaggcttactaaccaggtaagccttctatgcatccacaccaaaatcctgcagaatgtaagtaagctctgctttataagatgggttcaccttcatcgcagactgaaagtttcagtttttatttttttcagaaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagagccttgactattttgaagattaaatgcacactttttatataaaaaaaaa

SEQ ID NO: 453 - DNA, 1448 bp, Homo sapien
gcctctccagctgcgacacagatggcgcgcgggctcttgggttctgtagttttctcgcgatccaaaaggctccgtgcccaaagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttttaaaaaaaaaaaaaaaaaaaaaaaaaaaaaaaaaaaaaaaaaaa

SEQ ID NO: 454 - DNA, 1912 bp, Homo sapien
gggcggccgacgacgttcgtcatttagtgcgggagggatcctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaaggaaaaaaaaaaaaaaaaaaaaaaaaaaaaaaaaaaaaaaaaaaaaaaaaaaa

SEQ ID NO: 455 - DNA, 6927 bp, Homo sapien
ggggggagggtggcggctcgatgggggagccgcctccagggggcccccccgccctgtgcccacggcgcggcccctttaagaggcccgcctggctccgtcatccgcgccgcggccacctccccccggccctccccttcctgcggcgcagagtgcgggccgggcgggagtgcggcgagagccggctggctgagcttagcgtccgaggaggcggcggcggcggcggcggcacggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcgggccatgggggccgcccggcgcccggggccgggctggcgaggcgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcgagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagagcaccggcagctgctgaaggacagcttcatggtggagctggtggagggggcccgcaagctgcgccacgtcttcctgttcaccgacctgcttctctgcaccaagctcaagaagcagagcggaggcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagaatgacatccagagagagaagagggcgaacaagggcagcaaggctacggagaggctgaagaagaagctgtcggagcaggagtcactgctgctgcttatgtctcccagcatggccttcagggtgcacagccgcaacggcaagagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcagccactggatttaagcagagttcaaatctgtactgcaccctggaggtggattcctttgggtattttgtgaataaagcaaagacgcgcgtctacagggacacagctgagccaaactggaacgaggaatttgagatagagctggagggctcccagaccctgaggatactgtgctatgaaaagtgttacaacaagacgaagatccccaaggaggacggcgagagcacggacagactcatggggaagggccaggtccagctggacccgcaggccctgcaggacagagactggcagcgcaccgtcatcgccatgaatgggatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcaataacaaggacgtgtcggtgatgatgagcgagatggacgtgaacgccatcgcaggcacgctgaagctgtacttccgtgagctgcccgagcccctcttcactgacgagttctaccccaacttcgcagagggcatcgctctttcagacccggttgcaaaggagagctgcatgctcaacctgctgctgtccctgccggaggccaacctgctcaccttccttttccttctggaccacctgaaaagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtccaggtgctgctgtacttcctgcagctggaggccatccctgccccggacagcaagagacagagcatcctgttctccaccgaagtctaaaggtcccagtccatctcctggaggcggacagatggcctggaaacctctggctaatcgggccatccgtagagcgggaaccttcctgaggtgtccttgggccacccccaagtgttgggccatctgccaagagacagcgacccaaagccgaaggacaggtggcctggaaagatcccgcccaggtctgggagccccaggctggcctcagactgtggttttttatgtggccacctgagggcgccccaagccagttcatctcggagtccaggcctggccctgggagacagggtgaagggagtggtttttatgaacttaacttagagtctaaaagatttctactggatcacttgtcaagatgcgccctctctggggagaagggaacgtgactggattccctcactgttgtatcttgaataaacgctgctgcttcatcctgtgggggccgtggccctgtccctgtgtgggtggggcctcttccatttccctgacttagaaaccacactccacttctaacagggtttgagaggcttagtcagcactgggtagcgttttgactccattcttggctttctttttctttccagaaggatttttgtgcagaaatgggtcttttgttgccatgttagtcctccttggaaggcagctcagaaggcctgtgaaatgtcaggggacaggacccccagggagggaaccccaggctacgcactttagggttcgttctccagggagagcgacctcgtcccccgatcctgaccgcccttccggcccacgctctcctgtttggcttccacaggcctggacttctctggcttctctgcccacacactccctgcccccagtgtccctgcccctgccccagcacaggtgacttcatttctgtcctctcagctcagtggactcgctcaacttttgtataagtctccacttggtggcagcagcttgctgatgacttgttttaaaactttcatcctaaataaccttttgatacttgaatatttgtaagttttatacatagtttctaatttttttccgaacagatccagatacctaataagatgctggaatgtaatccctggacaatccgtgtcctggcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccgacacctgcgggggagcccaggcattctttgtaaaccctcctgaccacctggctcaaagaaaacagaagcatggagaccgccaagtattttcaagaaataaccccatgaatattccatcacttttttagaaagaggggcttggggcaggcagaggagagaagggagagcaaactgagagccaagtttccacacggtcctgcaggaggagaggatgcagctgcccagagggaagcaggatcacatttaaggaagtgtgtggggtccctggatgacaccagcacccagtgcggctctgtctggcacccgctcccaaggtgggaggagtgggtgtcccctgtgtgtcagtgggcagctcctgctgaacccgcagctcactagggagcctgacagtggggccatgcgcctgacactcctctctgcttgtggacctggcaaggcagggagcagaaaacagccacttgaaggctttctgtctgcgtctgtgtgcagtgtggatttagttgtgcttttttcttgctgggagagcacagccaccatttacaagcagtgtcaccgtcgtgggtggcgaggacagaacaggagcctctgctctctgtacctatctgggcccggtgggctcccttgtcctggcttccatctctgtctcagcgaccattcagccctgcgcaggaacacgtgttgcttagaaaagccaaatccagccttgtctctgcctcctctggtctcatgatgtgcatctgttaccttgaaactggaaaccagtctatcaatgtctgtgccaattttttattccctccccaacctccttccccatacgactttttatttatgtaggatgtgtgctgtctaatgatgggatgaccacacttttccatgttctaaaagtgctcctctcccgcagggtcccagggctggtggttgctttgggtctacagctacgtcttacccacctcctgcctcaacagcctgtgtggtggcaaagccggtgtggggctggggaacgcagcgttctccaggagggggacctggctctccttctgcaatgcaggcgaaggcctagatgccagtgtgacctcccacaaggcgtggcttccagactccccggccggaagtgatgcttttttgccttgggccctgggtttgaagcagcctggctttctcttggtaagtggctggtgtcttagcagctgcaatctgagctcagccacctacacaccaccgtggccgacactttcattaaaaagtttcctgagacga

SEQ ID NO: 456 - DNA, 7723 bp, Homo sapien
atgccgctggcgcagctggcggacccgtggcagaagatggctgtggagagcccgtccgacagcgctgagaatggacagcaaattatggatgaacctatgggagaggaggagattaacccacaaactgaagaagtcagtatcaaagaaattgcaatcacacatcatgtaaaggaaggacatgaaaaggcagatccttcccagtttgaacttttaaaagtattagggcagggatcatttggaaaggttttcttagttaaaaaaatctcaggctctgatgctaggcagctttatgccatgaaggtattgaagaaggccacactgaaagttcgagaccgagttcggacaaaaatggaacgtgatatcttggtagaggttaatcatccttttattgtcaagttgcattatgcttttcaaactgaagggaagttgtatcttattttggattttctcaggggaggagatttgtttacacgcttatccaaagaggtgatgttcacagaagaagatgtcaaattctacttggctgaacttgcacttgctttagaccatctacatagcctgggaataatttatagagacttaaaaccagaaaatatacttcttgatgaagaaggtcacatcaagttaacagatttcggcctaagtaaagagtctattgaccatgaaaagaaggcatattctttttgtggaactgtggagtatatggctccagaagtagttaatcgtcgaggtcatactcagagtgctgactggtggtcttttggtgtgttaatgtttgaaatgcttactggtacactccctttccaaggaaaagatcgaaaagaaacaatgactatgattcttaaagccaaacttggaatgccacagtttttgagtcctgaagcgcagagtcttttacgaatgcttttcaagcgaaatcctgcaaacagattaggtgcaggaccagatggagttgaagaaattaaaagacattcatttttctcaacgatagactggaataaactgtatagaagagaaattcatccgccatttaaacctgcaacgggcaggcctgaagatacattctattttgatcctgagtttactgcaaaaactcccaaagattcacctggcattccacctagtgctaatgcacatcagctttttcgggggtttagttttgttgctattacctcagatgatgaaagccaagctatgcagacagttggtgtacattcaattgttcagcagttacacaggaacagtattcagtttactgatggatatgaagtaaaagaagatattggagttggctcctactctgtttgcaagagatgtatacataaagctacaaacatggagtttgcagtgaagattattgataaaagcaagagagacccaacagaagaaattgaaattcttcttcgttatggacagcatccaaacattatcactctaaaggatgtatatgatgatggaaagtatgtgtatgtagtaacagaacttatgaaaggaggtgaattgctggataaaattcttagacaaaaatttttctctgaacgagaggccagtgctgtcctgttcactataactaaaaccgttgaatatcttcacgcacaaggggtggttcatagagacttgaaacctagcaacattctttatgtggatgaatctggtaatccggaatctattcgaatttgtgattttggctttgcaaaacagctgagagcggaaaatggtcttctcatgactccttgttacactgcaaattttgttgcaccagaggttttaaaaagacaaggctatgatgctgcttgtgatatatggagtcttggtgtcctactctatacaatgcttaccggttacactccatttgcaaatggtcctgatgatacaccagaggaaatattggcacgaataggtagcggaaaattctcactcagtggtggttactggaattctgtttcagacacagcaaaggacctggtgtcaaagatgcttcatgtagaccctcatcagagactgactgctgctcttgtgctcagacatccttggatcgtccactgggaccaactgccacaataccaactaaacagacaggatgcaccacatctagtaaagggtgccatggcagctacatattctgctttgaaccgtaatcagtcaccagttttggaaccagtaggccgctctactcttgctcagcggagaggtattaaaaaaatcacctcaacagccctgtgaagtgacctcagtgagatatttggtaccatggtgtaagctgatagcacaagttctggcgacaggtagcacgtatctgagagacacctgcaagcacacactgtcccagctggtacccataatgctgctgttcctgctgctgctcctgctttcctctcttctcgctttaaatgattgttagcaagttagattttcctggagcttcggaagaaatgaaaatggaaacatgatgaagatatagtcactgaatcaatgagaaaaataatgaacatatgaataccacctaaaaatacactgaataaagtacaccatatagcattatttttataggaaatatttcatgtcccttaaatattctttgttagttatagggatggacagtttatgttaagcacttagcttaaacaatccgtttatattagcactgtatcccttgtgccatccaacattttgtatgtttttgtaaacagttcatatacagtacatttctgtactgctttctttaatgtatacatgccttgtttaacttggaatctattattattaatcaattgactattaaatctggttaaatagttcacctggattaacagtattgttggacagtcctaaaaatggccagattgtggaacagctgttgaatgtaatacttccaaaatgtacatatctttccccacgtctgtttcactggttcgttcatttgtttgtttcttaaagtcaggtgctctgtcagactaacctagagagctgttatggtagagaaagttatcatatgtgtgtggcatgaaatcaagaatacacctatgaagttagtccatatactttgcaactccttagagtacttttttccttaattaaggaagtagtccttgcacttctaatcttacatagcatccatacttagaatttggcatatcatctgggattttgccaatatacgtcaaagccctttaagagtcatggtaaggagatgggtgaaggaaaatttagcaacaggtaattgaagtcctattggatatttcatgtttaaatagatattctatattaaacactaatttaaatgtaataaaggccaaaggcctctgtatgaaattggatttaaactttcttattttagggaataaaacattattgatcaaacagtatctgttctaacctaaaattataggtagggcaggctaagtgaacagcattgagtattttctgaatccctcatgataatttatagccacatactgcttcctttgacttcaggaatgatcagttttcataatggccactgggcctgcttagattgcagtattcattatctgcatctaatttggtagtttccacaatcgtatttgatgaaagaaacttcagtccccattattacctgtgtctttgccaagctgcctagcatacatcagtatgtaatgtaaaagacatatgagcaagaaaaaagtgatttaacttacctcatcaagaatgtgcccctacaggccgggcgcagtggctcacgcctgtaatcccagcattttgggaggccgaggcaggtggatcacctgaggtcaggagtttgagaccagcctggccaacatggtgaaaccccgtctctactaaaaaatacaaaaattagctgggcatggtggcgtgcacctgtaatcctagctactcaggaggctgaggcaggagaatcgcttgaacctgggaggtggtggttgcagtgagccaagatcacaccattgcactccagcctgggtgacagagtgagactctgtctcaagaaggaaaaaaaaaaaaaagaatgtactcatacagatttttgttagtcatcatgtaataagccatttatatcagaaaccttttttcctgccacagaagctttaaattttcccctaagagtacaaagccaagagagtgtggtttatctaaatgtcctgaaatccacttgtcattccttaatttctcctctatgcaattaaagagaaaggggaaatctataacatttcttttgcccaagtgacacaaaaatgattactgcatagaaatcaaatgtaagtttagcttctaaatgaaataatatataggagggatatcagaatgtctagatagagaaagtattttcaaattcttgaatatatggatgctattaaaagctgctttccattgcctggaaagagagcttttttccctcctctattcagtgtttcaaactttggtcatctcaaattattgtcacttttaaaatgttaatgtcattctgagcagaaatagatatattttcagatttttttacactgatgctactccgtaattgcttaggagtattgtccatcatagtattttagaactagaagtaaacacataaatccttataaattacccaatccaactttctcatattgcatgtagagaacctgagacacatatcaaagtctagaatccttaacttctccccattttgtttttttccgcctcatcacaccatgctgcctttccctcatatgatcaccaaccagtagctgagttcaaaaactacatatttcttgggcagtcctctactggtatgtgatgccaacttttatttctttcgaagataattgccttctttgcctagccaagcagccaattttattggagaaaagcaagttatatgttcacaaaatggaaggctttctacctaaatttatttcatctgtggtcctcttattctcttccattgcttttgacatacagtggaaaaacttggccaacgatgtgctctaaatatagtgcttgtgttgggttaacttttccattaatttctcaacatcaattattcaggcccctacagttgtggtattgaggcccctaaaggcttctgcctttcaccaattagtgctgccagttactgaggcttctcccaaaaggtatcagtccagtcttaaagatatttcattgtgaaagaagaaactaaactatcaggcctcttttacaaaatgagagattgaatttaagcttgtcaagcacgtactggaaggtatgaattacactaccatgtgttttgtatcttccctttcaagtgatgatgttaaatgaaggtaagtttttcatccttttttaatttttgttttttataaatcatttcagctttttctggtttatagaggtgtcttatttctaatgcaacagacccccaactttaacagatttgatatggatgcatttattcacaagcaaccccaaaagtccaaaaatgtaataattttgacaaggcccaaagttgagatgctatgaagcttgtgtgtgtgaaaagtcagttatgattgtctggagagaagctgtggtgtgtatgctgtagagtttccacatttcacatgcagtgtactccaaaaagcgggtttgggtcaaccatttcccatctctttttaagaagtgactgctgttggggccaggggacatcatgggaggtggggctgtccagttagctgtgccctgcaccttcagcccaggaaagatttgaacagagcaaaggcttcaagagagggcagaatgtattcggcagaaaagggactcaggtaagcccagcctgggatgagagcagaaaagcattcaagatttgcaggccttgctatggatgcgcttaatcaccatggaggccagcaatacccatctcagcatggctttgatattctctacttcctggcctttaaaaatgacctataatttttcagtttgctttactatattttataaagaaaattctatcttatggttgattgagcattgagacttatgaaggcattaggatagatagctcaggaatgtaaaggttcagaaaaggtctgttttctcagattaacaaatatgatggattccatggctgaccttggtgcttaaaccaggaggtttcaatctagtcctagagttgtgtccctctgaaaggcccaatgccatgtaactaactttaaactggatatatactttgagccttacttaattcacagataagttgacttaactcagtatttttatttcaattaatgaaaacagtcctcttttcaaccccaggttgcttacattttgctggtctccccaagtgaccattggtggagaccaattaatgaaggaatgaaattcactttattgggactgtggtattcaacagagccacacttaaccactttttccaatgaagaatctccagaatgataatgcccaaatatggatggccaagaagaatttgtatctacggtgtgctttatgtgtttttgacactgctgtattctgtgtgatcaagtgatttgcagctggttccaatgtgactgagtgttctcaaagatttctagtaactaagtcaacttaattttcttaagcctggtattactatcagcctcacatttaccactttgattctagttttttaactgttcataacagggcataccgagggttgggatgagagcctacttcctacctcttaaggcactttcctcattattttgccatataatcttgaactgcatgataagctgtttaaatgtccatgacttctcccagagcaactagcaaagtatatgacattttgaatagagattagtggaaaggaaaatgtagagatttaagttcagaggtacaaacctcaataaaacctccttagagcacataccatgagtagagtatatgtaaacgtatatgagaagagagtcgctataatagtcctctctaagtagattagttcattgtctaatggaagtgaacatctttactcctgttatcaccatagtactgaatgaactgtataatgagtttttcaaacaagtatttaaaatagaactttcacgtacaaagcaagggcataaagattttggtttgtgtttctgtaagtgtagtttaccatctaaagctttggtttttaattttaaaaaaagcttcaaggtattgccattccttagcatccttattgattatgggtgatgagtttttaactcttaaaatcatatacgtgtattagtttatcttaactgttgccctaagcaaaagggaaggtatacacctaagggatgtacttattttgcatttttggtcatgggtgggaatggggtgggtgcctacttaaatagtttttaaaaaagaaaaaaatcacaaatatttttctactgttatatatgatcttcctttatactagtttctctctagtaaggcatgccagaagcccaagataccatatcatgaattcttacatattgtaccttttgttggtggttaaatcgcatcagatgcttggcattgctgccataattataaaatgcttgtaaaggatcaaatatcactaaatactttaaattgttttacttaagagtctaatctgggaagttttcaaatcatactattaatgtgtaatctaagctcttcagatgtatccatgaataatcctggaacaatattgcttgtattcctgtcatagaacaggttttgtaatctttaaaagaaatgaaaatttatataataaagtttcaaatcaatgcaaaaaaaaaaaaaa

SEQ ID NO: 457 - DNA, 6103 bp, Homo sapien
atccggggcagcggggaatggctgagccaggggttcgccgcccccgccgccgccgccgccgccgccgccgccgccgccgcccgctttcggctcgggcctcaggaccgtagcatcctgagacattttgaattgacacttctcaagatttgactggatcagagttcatcatgtcaaagttgaaaagctcagagtcagtcagggtggtggttcgctgtcggcccatgaatggcaaggaaaaggctgcttcgtatgacaaagtggtggatgtggatgttaagctggggcaggtgtctgtgaagaaccccaaagggacggcccatgaaatgcccaagaccttcacctttgatgccgtctatgactggaatgccaagcagtttgaactgtacgatgagacgttccgaccacttgttgactctgtcctgcaaggtttcaatggaaccatttttgcctatggacaaactgggacaggaaaaacctacaccatggaaggaatccgtggtgaccctgaaaaaagaggagtcattcctaactcatttgaccatatcttcacccacatctctcgatcccagaatcaacaatacctggtcagggcttcttacttagagatctaccaggaggagatccgagatttgctctcaaaggatcagaccaaaaggcttgagctcaaagagaggcctgacacaggagtgtatgtgaaagacctgtcttcctttgtcaccaagagtgtgaaggagatagagcatgtgatgaatgtggggaaccagaaccgttctgtcggtgctaccaacatgaacgagcacagctcgcgttctcatgcaattttcgttatcactattgagtgcagcgaggtgggcctcgatggtgaaaaccacatccgtgtaggaaaattgaaccttgtagatcttgctggcagcgaacggcaagccaagaccggcgcacaaggggagagattaaaagaagctaccaagatcaacctctccctttccgctttgggtaatgtcatctctgctctagtggacggcaaaagcactcacattccatatcgggactcaaagcttaccaggctcctccaagattcccttggtggcaatgccaagactgtgatggtggccaacgtggggcctgcctcttacaacgtagaagagactctgaccactctgcgatatgccaaccgtgccaaaaacattaagaacaaaccaagggtcaatgaggaccccaaggatgccctccttcgagaattccaggaagagattgctcggctcaaggcccagctggaaaaacggtccattggtaggaggaagaggcgagagaagcggagggaaggtggtggcagtggtgggggtggggaagaggaggaggaggagggagaagagggtgaggaggaaggggatgataaggatgattactggcgggaacagcaagaaaaactggagattgagaagcgggccattgtagaggatcacagcttggttgcagaggagaagatgaggctgctgaaggagaaagagaaaaagatggaggacctgcggcgggagaaggatgctgccgagatgctgggcgccaagatcaaggccatggagagtaagttgcttgttggaggaaaaaatatagtagatcatacgaatgaacagcagaaaatcctggagcagaaacgacaggaaattgcagagcagaaacgtcgagaaagagaaatccagcaacagatggaaagtcgagatgaggagaccttggaacttaaagagacatacagctcattgcagcaagaggtggacatcaagaccaaaaaactcaaaaagctcttctccaagcttcaggcagtgaaggctgagatccatgacctccaagaagaacacatcaaggagcgccaagagctagagcagactcagaatgagctcaccagggagctgaaactcaagcatcttattatagaaaactttatccctctggaagaaaaaagtaaaattatgaatagagccttctttgatgaagaggaagatcattggaaactacatcctataaccagactggagaaccagcagatgatgaagcggccagtctcagccgtgggatataagagaccattgagccagcacgcaagaatgtccatgatgattcgtccagaggcccgatatagggcagaaaacattgtgctgttagagctggacatgcccagccggaccaccagagactatgagggtccagccattgcccccaaggtccaggctgcattggatgcggctctgcaggatgaagatgagatacaggtggatgcatcatcatttgaaagcactgcaaataagaaatccaaggccaggcctaaaagtggaaggaagtcgggatcctcctcctcttcctcaggaacccctgcatctcagctttatccacagtctcgggggctggttccaaagtaaagccagcttctcctctcccagggcggaaacagcatttgccttctgagagaagagactagcaaaaagctgcagagaggattcggcccaaactcagaactgttcccctgaggagaagcggtggcctctttgcagatcaaccaacttaatctggttgaacgtgctgttcctaatctggcactcagcccctctgggaaacatcttttaattagcatctcagaaatgcatgggtaaggtaaagtgcgatagttcaagtggaaagcaagagaatgaccagtgaccttgcttccttcccccttgccttcttctcccccttcccctgtgctccctttctctcctctctccttttctagcctgttctttacatggggctcccttcttgttgaacaatagggcagaatcaggagtcaccttagcaggaccacatctttggagcctcgggataaaatgacagtgaggttgaaaagtgaaaaccctagaacttgaataggtgcctgttcttgtagggagaaatgagaaatcgcatttggatccaggccccaggtgggcaccatcagcagtcttgcttccatgcacctcagtaagaagtggatctgcctttgggacctgctcagtgaggaaatctcttccaatttctgcttctgaatgattcaatgttgggagcaatagaaataacattccctttgccttctctgagtgtttagggaaatagcttctttaaaacctcaaaaccatgaccatcctgtcaaagacctaagtctgtaagctggtgccatgtccatacaccatgtcactttactcttcatttgtcaccatcttttcccatgcacgcatactctgaacatccttgtgtgggcccatcctctgcatccagagcatgctctgcagtgggcctgttttgtggaagaaaggaggctgtctctgccttctctgatgggactggagttgagggaaggagctgtattgtggcacttctgaattccccgttttgttccatattggtatagagagcagaagagtagctaggcagatgcagagatggagacatgagactcagtgcagtgggcagggaagacataacagatggaagcaaaggaatcctgcctgccttcagcagagaattcaccgaatcctagaactgtggctccctccaggcagagcctaagatgctggtgaagaatagctgtgtgattgaataggctcaaaggagagttcagaattcccatttacatattactagtttggtttgtaagttttagttccttgtattattgagattcagagcttcattttatgttggtcattaggtgaatattactcattttccctcaagagaagctcataagtgtgtgtgggtgtgagagcacgatggtgcctgtgttctgtgaatgtgtccatatgtgtctgtaagagagacagagaccaagaacttgcccaattttagaaatacactaatgtgcagttgttgccttttgtctgtattgaaggcccattgaatgactaatccaggctggaagcattcccatgtgggtgtctgagtccatgagccaagcctgaggggacagtgagtctccaggtctgccacactggtgcaccttgctggcacggtgcctcaggaaggtggcgactcaggtgggccttgagttatattttaactcagctgctcagttcccagggcacatttctggatcagaacccatgggaaacaggaggtactaagtgcaatgtcttagcattctgcaaaatggagatctgttgtccagcggcttatctcctttttagtaacccttctttctgaacccagggcccttttcagccttccctcatattttcttgagatcaaactttacttctttcttatttactaagaatttgcctgtttgaataagaacaaaacgctaaggtgggtagcctaagctgattttctgctggttacacgtgtctctcacaccacatttcctcaaagctaatctgaattctgtaggctaaaaatattcatgtagcaaatctgagaattgaaaactgcagataaccggccgggtatggtgactcatgcctgtaatcctagcactttgggaggccgaggtgggtggaccacctgaggttaggacttcaagaccagcctggccaacatggtgaaaccccatctgtactaaaaatacaaaaatttgcctggtgtggtggtgcatgcctctagtcctagctactcgggaggctgaggcacgagaatcacttgaacctgggaggcggaggttgcagtgagtcgagataacactactgcattccagcctgggtgacagagtgagactccacctcaaaaaaaaaaaaaaaaaaaaaaaaaacagaaagaaagaaaaagaaaactgcagataaccctatacattaatactggtatctcgaggtgactcttctgaccaagggtggttaagtgacacatagaacttttctaagagaagacagacaagttgacaggcatgccttgtactcagctgtgttcatgtggtggtctgtggaaagaaaagaagactcatttggaaatgaagctgtccctttccaagcagtctctggtgcttttcttctctcaaaatggatccgataaatatttgaatagagcagattgtagaatgtcgtgctgtcaccagaaagctgctgttttgggttctgcattgagccaaatatgtagaggacctaccaagcccactgagggactaggttttcatgtctctagtcatacctagaatgttctgagccgtctgagggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcatattttcaagtcacatgtctctcagacccctggattcagaacccaaggccacaaatcataggcatgaagcactttcttaagactgacctaacgctggattatttcccgtccaatgcctgcatgctgcttgaattgctccacccacacctccatgaccaagggcgccagagtgctgcaactggggcgtgggccgctctctgcttttcctgtctgactctgacaagtcctccctcactgaatgtagaatcgttgccaagtttctgagaagtgtcgattccctgttaacatggatatcagttctgcctcacatttcccacttgaggttgaggcgtactggagacaacacctcagaccatctgaaccccatcagtggacgaaaatggggctgttaatatactctaaaagccatactaaaaatgctctgagggaactggctaagaatagtgggcctggtgattgtctatcacgcaaggctttgttttgtactgttcagaaatctgtcacctttctgcctgcccttgtttcctgaatgaaatgcttctggggttatttatgaaaggagtgatcctggggcaggcaggaggcagtgggcttcatggctccttgaagttattactgatcttgaccttctctttggctacctttagacaaagaatacgccaatcaatacttggggctctaagttttacaattgatatttatttgtatcatctctttgtctaggaatgtaaaagtgattctaaactaagatgtgtaataaaaatcaatcagatttattgtacctacaaaaa

SEQ ID NO: 458 - DNA, 1027 bp, Homo sapien
gactcccaagatggcggacctactgggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtgtgcccgtggccaataagagggacacacgctccattgaagaggctatgaatgagatcagagccaagaagcgtctgcggcagagtggggaagagttgccgccaacctctaggcgccccgcccagctccctttgacccctggggcagggcagggggcagggagagacaaggctgctgctattagagcccatcctggagccccacctctgaaccacctcctaccagctgtccctcaggctgggggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttccccatggggctggggtactttacattcaataaatactgtttaacccaaaaaaaaaaaaaaaaaaaaaaaaaaaa

SEQ ID NO: 459 - DNA, 1489 bp, Homo sapien
tccctgggactgcgtcactggtgcgcgccgcgggtcagggcgcaatggcggcgctgggcggggatgggctgcgactgctgtcggtgtcgcggccggagcggccgcccgagtcggcggcgctgggcggcctgggccccgggctgtgctgctgggtgtcagtgttctcctgcctcagcctcgcctgctcctacgtgggcagcctctacgtctggaagagcgaactgcccagggaccatcccgcggtcatcaagcgacgcttcaccagcgtcctggtggtgtccagtctctcacccctgtgcgtgctgctctggagggaactcacaggcatccagccaggcacatccctgctcaccctgatgggcttcaggctggagggcattttcccagcggcgctgctgcccctgttgctgaccatgattcttttcctgggcccactgatgcagctctctatggattgcccttgtgacctggcagatgggctgaaggttgtcctggccccccgctcctgggcccgctgcctcacagacatgcgttggctgcggaaccaagtgatcgccccgctgacagaggagctggtgttccgggcctgtatgctgcccatgttagcaccgtgcatgggcctgggccctgctgtgttcacctgcccgctcttttttggagttgcccattttcaccatattattgagcagctgcgtttccgccagagcagcgtggggaacatcttcttgtctgctgcgttccagttctcctacacagctgtcttcggtgcctacactgctttcctcttcatccgcacaggacacctgattgggccggttctctgccattccttctgcaattacatgggtttcccagctgtttgcgcggccttggagcacccacagaggcggcccctgctggcaggctatgccctgggtgtgggactcttcctgcttctgctccagcccctcacggaccccaagctctacggcagccttcccctttgtgtgcttttggagcgggcaggggactcagaggctcccctgtgctcctgacctatgctcctggatacgctatgaactctcaccggctccccagccctccccaccaaggggtactgcaggggaagggctggctggggtccccgagatctcaggaatttttgtaggggattgaagccagagctagttgcgtcccagggaccaagagaaagaagcagatatccaaagggtgcagccccttttgaaaggggtgtttacgagcagctgtgagtgaggggacaaggggcaggtcccaggagccacacactcccttcctcactttggactgctgcttctcttagctcctctgcctctgaaaagctgctcggggttttttatttataaaacctctccccaccccccaccccccaacttcctgggttttctcattgtctttttgcatcagtactttgtattgggatattaaagagatttaacttgggtaacatggcaaaaaaaaaaaaaaaaaa

SEQ ID NO: 460 - DNA, 2512 bp, Homo sapien
gcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccagcaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttgtttttttttttttttttttttttttttgcttggcgaaaacactacaaaggctgggaatgtatgtttttataatttgtttatttaaatatgaaaaataaaatgttaaacttt

SEQ ID NO: 461 - DNA, 1599 bp, Homo sapien
actcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatgggggtgatatacgtgcctttaacagataaagaaaagcagtggtccaggtggaagtgattttatcttctgctctttcttcttccacacatgcaagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacacttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccttaagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaagaggc

SEQ ID NO: 462 - DNA, 7758 bp, Homo sapien
cagaggtctagcagccgggcgccgcgggccgggggcctgaggaggccacaggacgggcgtcttcccggctagtggagcccggcgcggggcccgctgcggccgcaccgtgaggggaggaggccgaggaggacgcggcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgacattaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggagagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggacgaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtgggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagatctctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgttaaaaaaaaaaaaaaaaaaaaaaa

SEQ ID NO: 463 - DNA, 4611 bp, Homo sapien
tggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacatcttattgatgaattggattacatactgttgccaactgaaggttggaataaacttgtcagctggtacacattgatggaaggtcaagagccaatagcacgaaaggtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattagtgatagaacagaaaaatgaagatggaacatggccaaggggtccttctactcctaatgtgaaaaactcaaattactgtcttccatcatataccgcttataagaactatgattattcggaacctggaagaaacaatgaacagccaggcctctgtggcctaagtaacttgggaaatacgtgtttcatgaactcagctattcagtgtttgagcaacacacctccacttactgagtatttcctcaatgataagtatcaagaagaactgaattttgacaatcccttaggaatgagaggtgaaatagctaaatcttatgccgaactgatcaagcaaatgtggtctggaaagtttagctacgtcaccccaagagcctttaagacacaggtaggacgttttgcacctcagttctctggatatcagcagcaagactgtcaagaactgttagctttcctattagatggattacatgaggatttgaatagaattaggaaaaaaccatatatacaattaaaagatgcagatggaaggccagataaggtggttgccgaagaagcctgggaaaaccatttaaaacgaaatgattctatcatagtagatatatttcatggccttttcaaatcaactttagtttgtcctgagtgtgctaagatttcagtaacatttgatcctttttgttacttgacacttccattgcccatgaaaaaagaacgcaccttggaagtttacttagttagaatggatccgcttaccaaacctatgcagtacaaagtggttgtccccaaaattggaaacatattagatctttgtacagcattgtctgctttgtcaggaatacctgcagataagatgatagttactgatatatacaatcatagatttcacagaatattcgctatggatgaaaaccttagtagtattatggaacgggatgatatttatgtgtttgaaattaacatcaataggacagaagatacagagcacgtgattattcctgtttgcctaagagaaaaattcagacactcgagttatacccaccatactggttcttcactttttggtcagccctttcttatggctgtaccacgaaacaatactgaagacaaactttataatctcctgctcttgagaatgtgccgatatgtcaaaatatctactgaaactgaagaaactgaaggatccctacactgctgtaaggaccaaaatattaatgggaatggcccaaatggcatacatgaagaaggctcaccaagtgaaatggaaacagatgagccagatgatgaatccagccaggatcaagaacttccctcagagaatgaaaacagtcagtctgaagattcagttggaggagataatgattctgaaaatggattatgtactgaggatacttgcaaaggtcaactcacgggacacaaaaaacgattgtttacattccagttcaacaacttaggcaatactgatatcaactacatcaaagatgataccaggcatataagatttgatgataggcagcttaggctagatgaaagatcttttcttgctttggattgggatcctgatttgaaaaaaagatattttgatgaaaatgctgctgaggactttgaaaaacatgaaagtgtggagtataaacctcctaaaaaaccctttgtgaaattaaaagattgcattgaactttttacaacaaaagaaaagctaggtgctgaagatccctggtattgtccgaattgtaaagaacatcagcaagccacaaagaaattggatttatggtccctgcctccagtacttgtagtacatctcaagcgattttcttacagtcgatacatgagagacaagttggataccttagttgattttcctatcaatgacttggatatgtcggaattcttaattaatccaaatgcaggtccttgccgctataatctgattgctgtttccaaccactatggagggatgggaggaggacactatactgcttttgcaaaaaataaagatgatggaaaatggtactattttgatgacagtagtgtctccactgcatctgaagaccaaattgtgtccaaagcagcatatgtactcttctaccagagacaagacactttcagtggaactggcttttttcctcttgaccgagaaactaaaggtgcttcagctgccactggcatcccattagaaagtgatgaagatagcaatgataatgacaatgatatagaaaatgaaaactgtatgcacactaactaatgaaagtcctagaagccataaaagagacactttcctgctggtggtatctatggaaatgatgaagttacccaccacattaaaacaaaagtctgagatggggagtttcagataaccgaatgtaaatcctttatcagattttaacttgtgcagtacttgaagtgaaacacaatgaaaactttaacagaaattgtctcttaatacatttacagtcttgtatttacaagctaaatatatataggaaatcacaaataaatcccttttaagtttgctgctgttttgattaattatgtttcctttaattttttggatgtgagttgatgacaaatgttaaatttgtggatgttggtcatttattttgctctaataatactgcaagaaaactatggctgaacttagtttttggataatctagttcatgtgcattaggctgccgtatatactactatgatatttagctgcagtatcaatgtggcataaatactgcggcagcattcttcgaaaaccgcattttcaaatttatccccgtaatcaatgtgggcctattaaaaaaccaaatcatgatacaagaaacaaccttggaaaagttatttccctttgtaatacctttaaaaatccagagtattatattcattttactgccactgtggaaacaggttctagatttcatactccatctaaagtcatttttcagttacatgtaagtattatttactgctattgggatctattcttcagatattcaaaaacattttttgctttaaaatgcatatctttaattgggtgttggtccaaaattaaaatttttgctgtctgtttttctctaccccattttgtggtaatttggcaacttgagctctcccaattattgtaatataaggacagacataatagtattctgtacccatagtaataattgcatcaagcttagatgagaaatttttttcatatactggcctttaaatcattaatggacaattggctataaaggtaggtctgttaactttctttgtgtgttcctgatggaattcaccatagccttacagcttttctcagaaggtaacttgttataagagaaatggcatttgcatgttccagagtcagaacctgtacagtatataaagcataaacaccttgaatttgattttagttcaccacattcaaggatccaggatgccaaaaatatgtgtgaacatttgaaacatttttatttgctgctttttccctttgatatagttgaaagaatgtattgtaaattggcatacaatactgcctttaatagaaaacctaaatgctggggcacatttcacatatcgactacctgagaaattgctttgtgtcccactgttattaaagcaaaaagtataatgttcttcacttgaactaatcaaatacaatagattataaattgtgtattgtaaataaaagttcactctgtgagtgcacattttggtaaattatttatttatgttagcatttaaaagtttaaaaaaaatgcatttgaccaggataaatgaggtatgttgatcatggctttgctttatatcttgatattaaagctggtttatcatcctggtattttaaaagctgctttggggttttttttttcttttttttttttttaatgtaaactaacctcctgcatgacagaggttaaaattttgtctgcacttgagttcacttgagtttacatttgaaatgtgcatgtttatttatatagatttcaataaagctattcaaggcctt

SEQ ID NO: 464 - DNA, 3209 bp, Homo sapien
attcccatcccccttctctagtccccgacctgcggcagccggagctcggggagcggagcgtggtggggaggggagcgggacaggcgacacaggagacagcggcgccgcggcctctccccaccaggcggccccggatcctactggacgccctgagggcacaccgaccgcgcctctagagtcaccccacgccgacccctcccctcttctctagacttatttccatccttcccgcttttaccctccccacccctccctgggctccaggccgccgccccctcctcactcctggaccggcccttctcggtgcccctcttccctagggagatgcgatgagccggtgcccccgcgtcctcatcgtcgccccgggcacggtgcccgtccagtgcccgtggtggggagggagcactccgcggtccctccgtgacgcccctcgcttggccccccccacagctggcgtccctcggccatgccccaggggacccagccagggggtgggctctagagcgagtggggtggagaggagaaaggacggggccttgggcgcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgctggcgttctccggggtggttggcattgtgtcctggaagcggccattcactctagtgatctccttcttctccttgctttcggtgctctgtgtcatgcttagcatggctggctctgttctctcctgtaagaatgctcaactggcccgagacttccaacagtgctctctggaaggaaaggtctgtgtgtgctgtccctctgttcccctcctccggccctgtccagagtcggggcaggaactgaaagttgcccctaactccacctgtgatgaagcccgaggggccctcaagaacctgctcttcagcgtctgtgggctcaccatttgtgccgctataatctgtacactctctgctattgtctgctgcatccaaatcttctccctggacctcgtgcatacgctggcccctgagcggtcagtctcaggcccactgggacctctgggctgcacgtccccgcccccagcccctctcctacacaccatgctggacctggaggaatttgtcccgcctgtgcccccaccgccctactatcccccagagtatacctgcagctcagaaacagatgcacagagcatcacgtacaatggctccatggacagcccagtgcccttgtaccctaccgattgccccccttcttatgaggcagtcatgggactacgaggagacagccaggccactctctttgaccctcagcttcacgatggctcgtgcatctgtgaacgagtggcctccattgtagacgtgtccatggacagcgggtctctggtgctgtcagccattggtgacctccctgggggctctagcccgtcggaggactcgtgcctgctggagctgcagggctccgtgcgctccgtggactacgttctctttcgctccatccagcgcagccgtgccggctactgcctcagcctggactgtggcctgcggggccccttcgaggaaagccccctgccacggcgccccccacgggctgcccgctcctattcctgctctgcccctgaagctccacccccactgggtgcccccacagctgcccgcagctgccaccggttggagggctggccgccctgggtgggaccctgcttccccgagctgaggcggcgggtcccccggggagggggccgcccagccgcagccccgcccacccgagccccgactcgtcgcttcagcgatagctcaggttccctcaccccaccggggcaccggcctcctcatccggcatccccaccaccgctgctgctgccacggtcccacagcgacccaggcatcacgacctccagtgacactgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggactgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttgttttcttgatcaaaaaaaaaaaaaaaaaaaa

SEQ ID NO: 465 - DNA, 4207 bp, Homo sapien
agcggggtggcgccgctactgctgccgcccccggggcgcgagtccgccgcccgccgcccgggcacccggcgaggggcgggggcagctccgaaccggccccagatccttcccgcttccgcctcacgcttcccggaaagcttgtccctctccgccgagctgctccgggagccccgccgcgccgagggtatctcccagagccccagctggtgtggccaggccccaggagtaggatggggctccccctacgagggccggtggcagccagaactgatacagcccccctggtctggggccaggacgccagctgaggagggcaggagtgtctggagctatggctggtgcctcggtgaaagtggcagtgagggttcggccctttaacgcccgtgagaccagccaggatgccaagtgtgtggtcagcatgcagggcaacaccacctccatcatcaatcctaaacagagcaaggatgcccccaaaagcttcacctttgactactcctactggtcacacacttcgacggaggacccccagtttgcatctcagcagcaagtgtatcgggacattggagaagagatgctgctccacgcctttgaaggctacaacgtgtgcatctttgcctatgggcagaccggggctgggaaatcctataccatgatggggcgacaggagccagggcagcagggcatcgtgccccagctctgtgaggacctcttctctcgcgttagtgagaaccagagtgctcagctatcctactctgtggaggtgagctatatggagatctactgtgagcgggtacgagacctcttgaaccccaagagtcggggttctctgcgggtccgggagcaccccatcctgggcccgtacgtgcaggacctgtccaaattggctgtgacctcctacgcagacattgctgacctcatggactgtggaaataaagcacggactgtggctgccaccaacatgaatgagaccagcagccgttcccatgccgtctttaccatcgtcttcacacagcgctgccatgaccagctcacggggctggactcggagaaggtcagtaagatcagtttggtggaccttgctgggagtgagcgagccgactcctcaggggcccggggcatgcgcctgaaggaaggagccaacatcaataagtccctgactacactagggaaagtgatctcggcccttgcagatatgcaatcaaagaagcgaaagtcggattttatcccctacagggactctgtgctcacctggctgctcaaggaaaatttgggggggaactcacgcacagccatgattgcagccctgagccctgctgacatcaattacgaggagactctcagcaccctcaggtatgctgaccgcaccaagcaaatccgctgcaatgccatcatcaacgaggaccctaatgcccggctgattagagagctgcaggaggaagtagcccggctgcgggaactgctgatggctcagggactgtcagcctctgctctggaaggcctgaagacggaagaagggagtgtcagaggcgccctgccagctgtgtcatctcccccagctccagtttcaccctcatcacccaccacacataatggggagctggagccgtcattctcccccaacacggagtcccagattgggcctgaggaagccatggagaggctgcaggagacagagaagattatagctgagctgaacgagacatgggaggagaagctacgcaagacagaagccctgaggatggagagagaagcattgctggctgagatgggggtggccgtccgggaggatgggggaactgtgggcgtcttctctccaaagaagactccccacctggtgaacctgaacgaagaccctctgatgtctgagtgtctgctctaccacatcaaagatggcgtcaccagggtcggccaagtagatatggacatcaagctgaccggacagttcattcgggagcaacactgtctgttccggagcatcccccagccagatggagaagtggtggtcactctggagccttgtgaaggagctgagacatatgtgaatgggaagcttgtgacggagccgctggtgctgaagtcagggaataggattgtgatgggcaagaaccacgttttccgcttcaaccacccggagcaggcaaggctggaacgggaacgaggggtccccccacccccaggaccgccctctgagccagtcgactggaactttgcccagaaggaactgctggagcagcaaggcatcgacataaagctggaaatggagaagaggctgcaggatctggagaatcagtaccggaaagaaaaggaagaagccgatcttctgctggagcagcagcgactgtatgcagactcggacagcggggatgactctgacaagcgctcttgtgaagagagctggaggctcatctcctccttgcgggagcagctgccgcccaccacggtccagaccattgtcaaacgctgtggtctgcccagcagtggcaagcgcagggcccctcgcagggtttatcagatcccccagcgacgcaggctgcagggcaaagacccccgctgggccaccatggctgacctgaagatgcaggcggtgaaggagatctgctacgaggtggccctggctgacttccgccacgggcgggctgagattgaggccctggccgccctcaagatgcgggagctgtgtcgcacctatggcaagccagacggccccggagacgcctggagggctgtggcccgggatgtctgggacactgtaggcgaggaggaaggaggtggagctggcagtggtggtggcagtgaggagggagcccgaggggcggaggtggaggacctccgggcccacatcgacaagctgacggggattctgcaggaggtgaagctgcagaacagcagcaaggaccgggagctgcaggccctgcgggaccgcatgctccgcatggagagggtcatccccctggcccaggatcatgaggatgagaatgaagaaggtggtgaggtcccctgggccccgcctgaaggatcagaggcagcagaggaggcagcccccagtgaccgcatgccgtcagcccggcccccctcgccaccactgtcaagctgggagcgggtgtcacggctcatggaggaggaccctgccttccgtcgtggtcgtcttcgctggctcaagcaggagcagctacggctgcagggactgcagggctctgggggccggggcggggggctgcgcaggcccccagcccgctttgtgccccctcacgactgcaagctacgcttccccttcaagagcaacccccagcaccgggagtcttggccagggatggggagcggggaggctccaactccgctccaaccccctgaggaggtcactccccatccagccacccctgcccgccggcctccgagtccccgaaggtcccaccatccccgcaggaactccctggatggagggggccgatcccggggagcgggttctgcacagcctgaaccccagcacttccagcccaaaaagcacaactcttatccccagccaccccaaccctacccagcccagcggcccccagggccccgctaccccccatacactactcccccacgaatgagacggcagcgttctgcccctgacctcaaggagagtggggcagctgtgtgagtcccacatcctgggcagagggcctggtggggccccttgctaggagaagggaagacgcccgagacgctgcttccccagaagtgctggggcagggaggcccaggagatgagagagaaggtccgagtaggtgatagaagacaagggggagaccgagccggaggctgaggaaaggaagagggcacggagttgccaggagcaaaccaaagtgaagagagagataggaagctgcctcggggccaccccttgcaaagggggtgtgtcccacaaacgctgctatgggtggggtggggggctggggtgctgcgtagccagtgtttgactttcttttcaagtgggggaaagtgggagaggactgagagtgaggcaagttctccccagcccctgtccgtctgtctgtctgtctgtggtggtttctgtttcttgggaggcatggtaggatcataagtcattcccctccccttccaggcctcctgctatatttgggggacctgactggtttggctggagtcccatgaggatgtgggccctttaataaaggatagcaaacaggaaaaaaaaaaaaaa

SEQ ID NO: 466 - DNA, 4120 bp, Homo sapien
ggctgctggcggcctgggctgccggggccgacgcctgggtggctgctgccgccgcgcctgctgcgagatggcgatcttgggcgcggaagggtgagggcgcccgccgcaggaggaggtgccgctgccgtggccgcccggctgccgggagccgacagcttcgcgccggggttgtctcctcacagactatgagctccttgaaagagggaatcgtgtcttactcatctttgtatccccagtgtctagcagttcctgatacatagttttagctgaattttgggacatggccactgcttcaccaaggtctgatactagtaataaccacagtggaaggttgcagttacaggtaactgtttctagtgccaaacttaaaagaaaaaagaactggttcggaacagcaatatatacagaagtagttgtagatggagaaattacgaaaacagcaaaatccagtagttcttctaatccaaaatgggatgaacagctaactgtaaatgttacgccacagactacattggaatttcaagtttggagccatcgcactttaaaagcagatgctttattaggaaaagcaacgatagatttgaaacaagctctgttgatacacaatagaaaattggaaagagtgaaagaacaattaaaactttccttggaaaacaagaatggcatagcacaaactggtgaattgacagttgtgcttgatggattggtgattgagcaagaaaatataacaaactgcagctcatctccaaccatagaaatacaggaaaatggtgatgccttacatgaaaatggagagccttcagcaaggacaactgccaggttggctgttgaaggcacgaatggaatagataatcatgtacctacaagcactctagtccaaaactcatgctgctcgtatgtagttaatggagacaacacaccttcatctccgtctcaggttgctgccagacccaaaaatacaccagctccaaaaccactcgcatctgagcctgccgatgacactgttaatggagaatcatcctcatttgcaccaactgataatgcgtctgtcacgggtactccagtagtgtctgaagaaaatgccttgtctccaaattgcactagtactactgttgaagatcctccagttcaagaaatactgacttcctcagaaaacaatgaatgtattccttctaccagtgcagaattggaatctgaagctagaagtatattagagcctgacacctctaattctagaagtagttctgcttttgaagcagccaaatcaagacagccagatgggtgtatggatcctgtacggcagcagtctgggaatgccaacacagaaaccttgccatcagggtgggaacaaagaaaagatcctcatggtagaacctattatgtggatcataatactcgaactaccacatgggagagaccacaacctttacctccaggttgggaaagaagagttgatgatcgtagaagagtttattatgtggatcataacaccagaacaacaacgtggcagcggcctaccatggaatctgtccgaaattttgaacagtggcaatctcagcggaaccaattgcagggagctatgcaacagtttaaccaacgatacctctattcggcttcaatgttagctgcagaaaatgacccttatggacctttgccaccaggctgggaaaaaagagtggattcaacagacagggtttactttgtgaatcataacacaaaaacaacccagtgggaagatccaagaactcaaggcttacagaatgaagaacccctgccagaaggctgggaaattagatatactcgtgaaggtgtaaggtactttgttgatcataacacaagaacaacaacattcaaagatcctcgcaatgggaagtcatctgtaactaaaggtggtccacaaattgcttatgaacgcggctttaggtggaagcttgctcacttccgttatttgtgccagtctaatgcactacctagtcatgtaaagatcaatgtgtcccggcagacattgtttgaagattccttccaacagattatggcattaaaaccctatgacttgaggaggcgcttatatgtaatatttagaggagaagaaggacttgattatggtggcctagcgagagaatggtttttcttgctttcacatgaagttttgaacccaatgtattgcttatttgagtatgcgggcaagaacaactattgtctgcagataaatccagcatcaaccattaatccagaccatctttcatacttctgtttcattggtcgttttattgccatggcactatttcatggaaagtttatcgatactggtttctctttaccattctacaagcgtatgttaagtaaaaaacttactattaaggatttggaatctattgatactgaattttataactcccttatctggataagagataacaacattgaagaatgtggcttagaaatgtacttttctgttgacatggagattttgggaaaagttacttcacatgacctgaagttgggaggttccaatattctggtgactgaggagaacaaagatgaatatattggtttaatgacagaatggcgtttttctcgaggagtacaagaacagaccaaagctttccttgatggttttaatgaagttgttcctcttcagtggctacagtacttcgatgaaaaagaattagaggttatgttgtgtggcatgcaggaggttgacttggcagattggcagagaaatactgtttatcgacattatacaagaaacagcaagcaaatcatttggttttggcagtttgtgaaagagacagacaatgaagtaagaatgcgactattgcagttcgtcactggaacctgccgtttacctctaggaggatttgctgagctcatgggaagtaatgggcctcaaaagttttgcattgaaaaagttggcaaagacacttggttaccaagaagccatacatgttttaatcgcttggatctaccaccatataagagttatgaacaactaaaggaaaaacttctttttgcaatagaagagacagagggatttggacaagaatgaatgtggcttcttattttggaggagctcttgcatttaaataccccagccaagaaaaattgcacagatagtgtatataagctgttcattctgtacagtgaattttccgaacctctcaaagtatgttttccgttcttccacagaaatatgcaaaacagttcatccttttctactttatttattgttcccttgaaatgactgaccaggaaaaagatcatccttaaattttgaagcaagtgagagactttattaaaaatacatatatatctatataaacatatatgatagtggctctagttttatagagctccaagtgtattaaacatgacagccattcattcataaagatctggatttgctttaccttgttaatattatctaggggaaaaagtgcaaattgctccatgttcttctctcccttatgtaacatctcctgagggtgtttagttgcatggctgttcagaaaggtattaagggcttaggccaaatcttactttgagtatgttaaaaaaaaaaaaatgctgctggcttttctgaagacaggtgcttgaacttgtcagtttgttttaaataaatacaatagttgaaaatttttctctgttacatcagtaatattgttaaagtaatggatagaaccataacttacacatgaaagtcatatactagatccaatactatttagtttattatcgaaattggaaggattcattgagcagcatagaagtttgtttacatgttactttgagatgctaggtatttgtggaattaaaaagaatcaggctcttttgtactttgtttttaaatctgtgatgcttttcaaatttaattcataataaattgatgcaatttcatacttaggaacatacaaaaggtaatgtaaactctgccacttttttgtgttcaaaattttggtttttatgaagccagatggattgaagagttacataagcatttgaatgctctaatataaggctaatgattttctgttagtgtttgaatatcttcattcctctcaaattcataacagttctatttaactgaattaaataaccatatgaaaaaaaaaaaaaaaaa

SEQ ID NO: 467 - DNA, 1648 bp, Homo sapien
ggaagttccggcgggggcggccgagggggaagagtgtgtctgcgggagaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacctcactcactagccccgctttgggccccctcctgtgacctcagggtttggcccatggggcccccccaggcccctgccccaactgattctgcccagataatcgtgtctcctgcctccactcagctgcttctcagtcatgaatgtggccatggccccggggtccccttgctgctgtgggctccctgtccctgggcaggagtgctggtgaggaggtggagccttttgaggggggccttccctcagctgtttccccacactggggggctgggccctgcctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctcaaaaaaaaaaaaaaaaaaaaaaaaaa

SEQ ID NO: 468 - DNA, 4071 bp, Homo sapien
ccacgcgtccgcgggttcccagaaagtagcttgatgagtgtccaaagtagcagtggaagtttggaggggccgccatcttggtcccagctctccacgtctccaaccccgggctcggcggcggcggccaggtccctgctgaatcacacgccgccatccgggaggcccagggaaggtgcaatggatgagcttcatagtctggatccaagaaggcaagagttattggaagctagatttactggagttgcaagtgggagcactggaagtacgggcagttgcagtgttggagctaaagcctcaacaaataacgaaagctctaatcacagttttggaagcttgggatctttaagtgacaaagaatcagagacaccggagaagaaacaatcggaatcatccaggggaagaaagagaaaagcagaaaaccagaatgaaagtagtcagggaaaaagtattgggggacgtggccacaaaattagcgactattttgaataccagggtggaaatggctcaagtccagtaagaggcatacctcctgcaatccgttctcctcaaaattcacattcacattccactccttcctcatctgttcgaccgaatagcccttctcctactgcattagcatttggggaccaccctattgtacaaccaaagcaattatcctttaaaattattcagactgatctcacaatgctgaaattagcagcattagaaagtaataaaatccaggacctggaaaagaaggagggacgtatagatgatttgctcagggctaactgtgatctcagacggcaaatagatgaacaacaaaaattacttgaaaaatacaaagaacgattaaataagtgcatatcaatgagcaagaaacttcttattgaaaagagtacacaagaaaagctgtcaagcagagagaagagtatgcaagatcgattacgccttgggcactttacaacagttagacatggcgcttcatttactgaacaatggacagatggttttgcatttcagaatcttgtgaagcaacaagaatgggtgaatcagcaaagggaagatattgaaaggcaaaggaaacttctagccaaacgcaaacctcccacagctaataattctcaggcaccctctaccaattctgaaccaaaacaaaggaaaaacaaagcagtcaatggagcagagaatgatccctttgttagaccaaatttaccacaactgttgactttggcagaatatcatgaacaggaagaaattttcaaacttagactaggacatctcaaaaaggaagaggcagaaatccaggcagaacttgaacgtttggaaagagtcagaaatcttcacatacgtgagctgaaaagaataaacaatgaagataattcacagttcaaagatcacccaacattaaatgaaagatatttattacttcatctgcttggtagaggtggctttagtgaagtgtataaggcttttgacctttatgaacaaagatatgctgctgtgaagatacatcagcttaataaaagctggagagatgagaagaaagaaaactaccacaaacatgcctgcagagagtatagaatacacaaagaactggatcaccccagaatagttaaactctatgattatttctccttggatacagatacgttttgtacagtgttagaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggaaacatcctactggtagatggaacagcatgtggtgaaatcaaaatcactgattttggtctgtccaagattatggatgatgatagctatggtgtagatggaatggatctaacttcccagggggcaggcacttactggtatttacctcctgagtgttttgtagttggaaaagagccaccaaagatttccaacaaggttgatgtatggtcggttggagtcatcttctttcagtgtctttatggtagaaagccatttggtcacaatcaatctcaacaagacattcttcaagaaaatacaatattaaaagccacagaagtccagttccctgtaaaaccggttgtaagcagtgaagccaaggcatttataagacgctgtttggcatatcgaaaagaagatcgatttgatgtgcaccagctggcaaatgacccataccttctcccacacatgagaagatcaaattcttcaggaaacctacacatggctgggctgacagcatcccctacacccccttcttcaagcataattacttactgactttcctccaagattggcatgatatctttgaatttgcttccagatgcacacttaagtttgagagcatttgagtgtttgttttctttttctttttttttttttttttttttacacaagacgtggttaagaactgtttgtgaactgaagttcctcatagtgtcatttgtatgagagaggatcatggacaatgaataaatgcacacttctgactataattttgagcagtgaaggaaggatgactgcctgttacacagaaacaggaataccatgttaagatagaggaaaaaaattttgtttatttgggggaacactgtaaataacgtttataatacttaaatacatttggttgttactagagagttctaatatgaagggtagtttttcattatttaaaaacacatggaaaaatatgagacatatttctaacatacgaactatagtgcctggatacattcttcagcatttggcagttaatctgctgaaaccaaagtaagaactgaatgacagtgacagttgtgttttatagtaatagaatgtgagagttagaatctttggacaaagttaggctttgtcatttgcctattcagacttttaccaagttgtacctcgagatcacatgtccgttttctttcactggttatattaaagggagagctattatttctaaatactttacacctttgacaaaatgagctgcttgtgttgaaatcagttgaattcactaaattataatattgccagtgttttcaacacgttagaattgataacaggtatttttcttttgttaccaggccttgttcatcaaaacaggtgacagtgagtaaccaaatgcagaccagttctatgcaggataatgataaattcccttctagctctattgtaaattgttgtacagatgtcatatttcaattactaagtttcagcagcttattcttgtacaaatgtttaaaatatggcttttctaattggatattgtattttttttaagtcttcttgaaggcactctaattgctgctaaatgatgttgcttctttgctaaaaaattaaatgacctagaaggtgcaagttgactgtacatcatagatattaaaaagcagacagtcattaacaatcaagatgtaaaagtgatccatgttggacataattgagtttttaaatcagtttattgggttctagggctgtagaacacatagatactagatttttaatttgttcatggttattctacatttctagaaagttcttatcagcaagatggtcccataagcaaatttcttgtggtttgtacagatttgttaaaatgtgaacgttttctaactgcctcgtagggtagaaaccaatatttttcaggatgctgtatttcactcctgtaaggactttttctttattgtcacattcataatgctgatacttacatgtaagttgttcatgttgcagaaaaaggttatacgtaccacggattctctttaatattgtacagttaaactgtatttctgatgttgcaagccattttgttttttcattgtacatagacacattgtctctttaaaatgctgctgaaattgtagagagtatagccaaaacagtaataaacaatgacagttaaaatgtaaagactatgaaaattacattggaagggagctttcaagatggtaggatattgactaactgagctccttcacttaaaaatcagctgaataaattccttaagtatacttcaaaaaaaaaaaaaaaaaa

SEQ ID NO: 469 - DNA, 1836 bp, Homo sapien
gggcgtgtggctgaggagatgccactaagcacagctggcatcctgagctcctcttctgccgcttccaacaggtcaaggaataaggctcgctatcggaccaaagccgtgagctctgaggtggatgagagcctctttggagatatcaagtccccagcccagggccagagcgacagccccattgtgctgctccgagataagcatacccttcaaaaaactctcactgctttgggcttggatcgcaagccagagaccatccagctcatcacccgggacatggtccgagaactcattgttcccacagaggatccctccggggagtccctaatcatcagccctgaggagtttgagcgaatcaaatgggcatcccatgtcctgaccagagaagaacttgaggccagggaccaggccttcaagaaggagaaggaagccaccatggatgcagtgatgacacgaaagaagatcatgaaacagaaggagatggtgtggaacaacaacaagaagctcagtgacctggaggaggtggccaaggaacgggcccagaacctcctgcagagagccaacaagctgcggatggagcaggaggaggagctcaaggacatgagcaagattatcctcaatgctaagtgccatgccatccgggatgcccaaatcctggagaagcagcagatccaaaaagaactggacacagaagagaagcggttggatcagatgatggaagtggagcggcagaaatccattcaaaggcaggaggaactggagaggaagaggagggaggaaagaattagaggaaggcggcaaattgtggaacagatggaaaagaaccaggaggagcgatcgctgcttgctgagcagcgggagcaggagaaggagcagatgctggaatatatggaacagctccaagaggaagatctaaaggacatggaacgaaggcagcaacaaaaactgaagatgcaagctgagattaagcgcatcaatgatgaaaaccagaaacagaaagcagaactgctggctcaggagaagctggcagaccagatggtgatggagtttaccaagaagaagatggctcgagaagcagagtttgaggctgagcaggagagaatccggagggagaaagagaaggagatcgcacgcttgagggccatgcaggagaaggcccaggattaccaggcagaacaggatgccttgcgggccaagcgcaaccaggaggttgcagacagagagtggcgcagaaaggaaaaggaaaatgcgcggaagaagatggaaacagaggctgagctgcgaaaaagtcggctcgaacaggtggctttcaaggagcacgctctggctgttcaggtgcaacgggaccgggatgagttcgagaggattcttcgggctcagagagaacagattgagaaggagcggctggaggaggagaaaaaggccacagggcgcttacagcatgccaatgagctccggcgccaggtgcgcgagaaccagcagaaggaagtgcagaaccggattgccacctttgaggagggccggcgcctcaaagaggaggcccagaaacgccgtgagcgcatcgatgagatcaagaggaaaaagcttgaagagctgagagccactggccttcccgagaagtactgcattgaagctgagcgcaaagctaacatcctgccagctacctctgtgaactgaggggagccttcgtggccctcaggatgccttcgggggacagattctgcccagtctctgggcatccataattgctgctaacctagacatttcatagttacagattaaatctacttgactttaaaaaaaaaaaaaaaaaaaaaaaaaaaaaaaaaaaaaaaaaaa

SEQ ID NO: 470 - DNA, 1733 bp, Homo sapien
ctctcacgcagccaacatggctccagtggagcacgttgtggcggatgctggggctttcctgcggcatgcggctctgcaggacatcgggaagaacatttacaccatccgggaggtggtcactgagattcgggacaaggccacacgcaggcggctcgctgtcctgccctacgagctgcggttcaaggagcccttaccggaatacgtgcggctggtgactgagttttcaaagaaaacaggagactaccccagcctctctgccacggacatccaagtgcttgcactcacataccagttggaagcagagtttgttggggtgtctcacctaaaacaagaaccacagaaggttaaggtgagctcatcgattcagcacccagaaacacctctgcacatttctggtttccatctgccctacaagcctaaacccccacaagaaacagaaaaaggacactcagcttgtgagcctgagaacctggaatttagttccttcatgttctggagaaaccctttgcccaacatcgatcatgaactgcaggagctgctgattgacagaggtgaggacgttccaagtgaggaggaggaggaggaagaaaacgggtttgaagacagaaaagatgacagcgatgacgacgggggtggctggataacccccagtaacatcaagcagatccagcaggagctggagcagtgtgacgtccccgaggacgtgcgggttggctgcctgaccacagacttcgccatgcagaatgttctgctgcagatggggctgcacgtgctggcggtgaacggcatgctgattcgtgaggcccggagctacatcttgcgctgccatggctgtttcaagacaacgtctgacatgagccgagtgttctgctcacactgtgggaacaagaccctgaagaaagtgtccgtgaccgtcagcgacgacggcaccctgcacatgcacttctcccgcaaccccaaggtgctgaacccccgcggcctccggtactcgcttcccactcccaaagggggcaaatacgccatcaacccccatctcaccgaggatcagcgcttccctcagctgcgactctcccaaaaggccaggcagaaaaccaacgtgttcgcccctgactacatcgccggggtgtcaccctttgtcgagaatgacatctccagccgctcagctaccctgcaggtccgggacagcaccttgggagctgggcggagacgcttaaatcccaacgcttccagaaagaagtttgtgaagaaaaggtgaagagcgagttcccgcaggcaaattggatgggcgtctggccgccgtggagttccggtgacccatttccccagccgtgtcgtctccaggaccacccgatggaaataacaggcgggcttcacggtgcggctctgtccgcccatgccccgctgggtctgcagggaactggactgtcccatggcctgtgagcaccggagcgcctggctgcctgccaaggaagtgcaattgcataaaaacagaaagaacaacgccctggagccaatcttcaagaaaggaatttccaaaggataatatttttctaataaatgcggctgcaacctcctgtgcatttaattaaataggccaaatttttgctgcttaggtcatctcaaggctgatacttgagctgtgtgcccagagatcatgcatttagatttatatttttgccagaaaatacaaggttataataaaactaagaactaccaaaaaaaaaaaaaaaaaa

SEQ ID NO: 471 - DNA, 3284 bp, Homo sapien
gagcggtgccgcaccggccgcgggcgcagggagtattatgggctgtgggtgccgctgagcaagatggagctgtctgcagtgggcgagcgggtcttcgcggccgaatccatcatcaaacggcggatccgaaagggacgcatcgagtacctggtgaaatggaaggggtgggcgatcaagtacagcacttgggagcccgaggagaacatcctggactcgcggctcattgcagccttcgaacaaaaggagagggagcgtgagctgtatgggcccaagaagaggggacccaaacccaaaactttcctcctgaaggcgcgggcccaggccgaggccctccgcatcagtgatgtgcatttctctgtcaagccgagcgccagtgcctcctcgcccaagctgcactccagcgcagccgtgcaccggctcaagaaggacatccgccgctgccaccgtatgtcccgccgtcccctgccccgcccggacccgcaggggggcagccccggactgcgcccgcccatttcgcccttctcggagacggtgcgcatcatcaaccgcaaggtgaagccgcgggagcccaagcggaaccgcatcatcctgaacctgaaggtgatcgacaagggcgctggcggcgggggcgccgggcagggggccggggcgctggcccgccccaaagtcccctcgcggaaccgcgttataggcaagagcaagaagttcagcgagagcgtcctgcgtacacagatccgccacatgaagttcggcgcctttgcgctgtacaagcctccgcccgcccccctggtagccccgtcccccggcaaggctgaggcctcagccccgggccctgggctacttctggccgcccccgccgccccctacgacgcccgcagctctggctcctccggctgcccctcgcctacaccacagtcctctgaccccgacgacacgccccccaagctcctccccgagaccgtgagcccatccgcccccagctggcgcgagccggaggtgctcgacctgtccctccctcccgagtcggcagccaccagcaagcgggcaccgcctgaggtcacagctgctgccggcccggcacctcccacggcccctgagcccgccggtgcctcctccgagcccgaggctggggactggcgccccgagatgtcaccctgctccaatgtggtcgtcaccgatgtcaccagcaacctcctgacggtcacaatcaaggaattctgcaaccctgaggatttcgagaaggtggctgctggggtagcaggcgccgctgggggcggtggcagcattggggcgagcaagtgagggggctccaccaaggaggggggcttgggggggccctcctgcccgaagtcatactcttgctcccaccccacccttgcccccagccctctctccctgtgctttgcttgtctcaaatggctcggtgttgacccagggatggggctgggtagttggggtcccagaaagccgggggtaggggccaccctggaatggggcaggggaagggcacaccccctgcccatgcatggtagcccactgggtggtttctggaaagccctagaaactagggttcctctgccccttccacatcccacctgtctctctagcttgcttcctgctctcctgtgcggcgtctgatttctcggtgctaacctggcagctgtggggcccttaggagccccccaccgagggtggacacagtccctttccttcctgcagatgcctaggcaggaggagggcttcctgcctgtttggcaaagtcccaggcagaggccaaggatgaggcctgactcggctcctccctccacatcagccagggcatcagaagttgggccagggcggggtcttccctgctcgattttggacgaggcctaagtagaccccctatgccctgccccagccctggctctttcctaaccccctcaacggtgggaggaactggcagagggtgcgcctggccacagcctccccgcatctaaaggccccttcagttcttgaccaaaggtgctacgagaacctgccgtggaaacttccagttgtgcgtctgccccactcgctgtgtttgtccgtgggttcatacatgcattgggtgctaggccccaggctgccgggtggcaccctttacagttcctttgaacaggggcattgaaggcctggactgcctctcgcctcagtaggcctggggaccaggcttgggtctggaggtttgctgtggaagtcaccaggcctcccctcctggcccaggtgtgctgggggcaccgtgccccccacccccctgccctcctcagggtggtcagcccaacctgtcggaccttcacttcacatcatggtggggaccgagatagagagggagaccccattccaagctccctcttcctcccggtgtttggggaggatgctgaagaatccattcccgagggcctcccggcttgtcccagcccctcttttgcttctgaccacggaggctttctcacagcccagcctgcctgaagcaaaggaggctcccgtgtcctgggcagcttctgtttccctctgctgcctgggagctgaggcacccgtgccagtggcagaggccacagccccagccttaggccaggccctgggagggcaggcaggcaaaggggagaccagagggtctgtgttctccaggagaatgagggtgttggtcccagaattgggaccggggccccgctggccagccctgggccacttcccgggtctccattgtgcgtgggtggcgtgttccaggcgtggctggagctggcttcctggctgtgctgccatgggcccctccctcagaagcacgttggcaggaggccgatcagaaccctagcgcctttggtcctaagaatgggaggctgccttccttcccaatctccctgccagggcccacagcgtggccctagccctcccctccccgggatgtagaacggggaccctcgcagggttggggcgggggctgatactcctcggcccctccctaccctgccctgtgtgttggctttgtggccgtccaagtgccaattggcttttcgcccaaataagggctggtatttctcctctgtccttggaggtgatttccccctgaccccctcccccaggtgagtgaccacctgggtgccagttacaggtgtttccagagaccatagaaatgtgttttcctgagagttcgtgtcattcgtgacttttttgtaaagaagttgtgttttcagaggtgattttatgacaggaaagtgaaagaattagttttgcaaaaaaacaaaaacaaaaaaaaaaaaaaaaaa

SEQ ID NO: 472 - DNA, 3912 bp, Homo sapien; identical to SEQ ID NO: 370

SEQ ID NO: 473 - DNA, 4403 bp, Homo sapien
gggggcggaaactccttggggaaagggcaatcccccgagccggttcccaggccgggtggagaccaactctggggtctgttggtgggagagtggggagcccgtcttctgctgagtgctgccgccccttcccaggacagcggaggtggaacttcgtcgcgctgcaacccccggctcgggatcctggggcgtcctttggcagtcgattgcaccctgcactagagagaagtccaggaatgatatattcttgggctgtatttctctaccctggagttcatccagttcatcccagaaacactgacctgattactgtgacaaagtctgatggatagaccctttctgttgaccttgtggcgtttttctttcatgtggaagttggaagacaaggtgaaaggggccaaaagttacctgctttggtgaataggagtgctctacttggttctcagaacatgggccctcgtttaaagctgcagctgtgatcctcggctgtctgttggcattgacgggacctgatgttttacgttattggtgggatcacagtgtctgtggttgcattcttcttcacaattaagttcctctttgagcttgccgcacgtgtagtcagcttcctccagaatgaggaccgcgagcgccgaggggaccggactatttatgactacgtgcggggaaattacctggatccccggtcttgcaaagtctcctgggattggaaggacccctatgaggtgggccacagcatggccttccgagtgcatttattctataagaacgggcagcctttccctgcacatcggcctgtgggactaagagttcacatctctcatgtcgagctagcagtggaaattccagtgaaccaggaagtccttcaggagcccaattccaacgtagtaaaagtggccttcactgtgcgcaaggctgggcgttatgaaatcacagtgaagcttggtggattaaatgtggcatatagtccctactacaaaatttttcaacctggaatggtggttccttctaagaccaaaattgtgtgccacttttctactcttgtattgacctgtgggcagccgcacacccttcaaatagtaccccgagatgagtatgataatcccaccaacaattccatgtccttgagagatgagcacaattacaccttgtccattcatgagctcggccctcaagaagaagagagtactggtgtctcatttgagaaatcagtaacatccaacaggcagactttccaggtgttcttgcgactcaccctgcattctcgaggctgcttccatgcttgcatttcataccaaaatcagccaatcaataatggtgaatttgacattattgtcctaagtgaggatgagaagaatatcgtcgaacgcaatgtgtccacttcaggcgtgagcatttactttgaggcttatctttataatgctaccaactgtagcagcactccatggcacctgccacccatgcacatgacctcttcccagcgccggccatccactgctgttgacgaggaagatgaagactcgccctctgagtgccacacccctgagaaggtgaagaaaccgaagaaggtgtactgctatgtgtcaccaaagcaattctcagtgaaggagttctacctgaagatcatccactggcgcctttacaccttccgagtgtgtccaggaacaaaattttcataccttggtcctgaccctgtccataagctgctcacactggtggtggatgatggcattcaacctcctgtggagctcagctgtaaggagaggaacattctagcagccacttttatccgctccctgcataagaacataggaggctctgagacctttcaggacaaggtgaactttttccagcgagagcttcggcaggtacatatgaaaagaccacattccaaagtcaccctgaaggtcagcagacatgccttgttggaatcgtctctgaaagccactcggaatttctccatctcagattggagcaagaactttgaggttgttttccaggatgaagaagctctggactggggagggcctcgccgggaatggtttgagctaatctgcaaagcactatttgatacaaccaatcagctcttcacccggttcagtgacaacaaccaagcattagtgcatcccaaccctaatcgccccgctcatctgcgcctgaaaatgtatgagtttgcgggacggctcgtgggcaagtgtctctatgagtcctctctaggaggagcctacaagcagttggtccgagctcgcttcacccgctctttcctggcccaaatcataggactgcgtatgcattacaagtactttgaaacagatgacccagaattctacaaatctaaagtttgttttatcctcaacaatgacatgagtgagatggagctggtctttgcagaagagaaatataataaatcaggtcaattggataaggttgtagaactcatgacaggtggagctcaaactccagtcaccaatgcgaataaaatcttctatttaaatttgctggcccaatatcggctggccagtcaagtgaaagaggaggtggaacatttcctaaaaggcctgaatgaattggtccctgagaaccttttggctatttttgatgagaatgagcttgagctgctgatgtgtgggactggagacatcagtgtgtctgacttcaaagcccatgcagtagttgttggtggctcatggcatttcagagaaaaggtcatgaggtggttttggactgtggtttccagtctgacccaggaggagttggctcggctacttcagttcacaacaggctcctctcagctaccacctggaggctttgccgccctctgtccctcatttcagattattgccgctccgacccatagcacgctgcctactgcacacacatgaaattcaatatagaaaatttggaaataagaaaaagaacaagggaaataggtaagttgctatccagaggtaatcaccgttaacactttgataaatagccttttgattttcatatttaagcacacatttgtctcccaacatctccctcacccacaaggggtttgggagtggcaaacaaaaatactgctcctaagaagtttgttggcggcaagtcttaccgattcttttcagcttacaaaggtaagcttggaagagaagaaaaaaaacagacctctgatttgggcctagaaggagtagtattaaggaccctgactttcttgggaaagtaattatgatgtcttgtatattggttcccaatctggaaaatgttaaaaaaattcccttttgaatttaaaaacaaaacaaaacagatccttgcccccaccccagacagtgcattctcctcttacctcatcaagctcctgagtgatatgagatatcttaaagggccaggcacagtgactcatatgtataatcccagtactttggaacactgcaaggcaggagggtcacttgaacccaggagttcgaggctgcagtgagctatgcctgtgtcactgtgctctagcctgggtgacagagcgagacactgtctctctttctctttttttttgaaaaggtggggttttggcatgtttcccaggctgatcttgaactcctgggctcaagtgatccacccacctcccaaagtgctgggatcacaagcatgagccatggggcccagccaaatgttcatatttttatttttaactcccgtggttcaactttgggcaagacaaccttctttcagtatcagtttcctgacctgcaaaatgatgctattaaccaattaagaaaatcgactaataacttaagagttcttgggaaaaaagttttcctatatatagtatgtgtgttaccatgctgactgtgacttagggccctggtagtttctgtagcaggaggctgtatgggtctgggggcagttgagaatgctagagtcgatgactggtgtggaaattcccagggggtggtgactctgtttttcaccttgccgtgtccaggcaggccagagagaatgagtactcaagacacctggcccaaacattcatgaagaagacaccaagtcagaagagacttcctcctttgcatgatcctgtaaggacggaagagctagcagctgtggatactccgaacagaccagtgaggcagagcagcaaaagcagcctggaactggaggcggccaggagaggagcagcaagccggtgcccacagtcagccacggcaccctcagcaggcccattaggaggaattgagaagcttctccagtgtttgccctaaaatctcaatccattttaagtgacagaaagtgacaaaaaacaccccagaggaaaatactggggcctaagggagtaatctcagaactcttgtaataataataataatagcagccaacatctaatacatgcttactctgtgccaggccctattctaaaaaaaaaaaaaaaa

SEQ ID NO: 474 - DNA, 4546 bp, Homo sapien
gtaggcggggcgagccggctgggctcagggtccaccagctcacccgggtcgaggggcaatctgaggcgactggtgacgcgcttatccacttccctcctcccgcctccccctggggtggcgctcgctggtgacgtagtgagtgtgatggccgccgcgaggccgggaaggtgaagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaacgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaagacacgtacaggaatgcagaactggaccccgttaccacagaagaacaggttctggacgtcaaaggttacctatccaaagtgagaggcatcagtgaggtgctggctcggaggcacatgaaagtggctttttttggccggacgagcaatgggaagagcaccgtgatcaatgccatgctctgggacaaagttctgccctctgggattggccacaccaccaattgcttcctgcgggtagagggcacagatggccatgaggcctttctccttaccgagggctcagaggaaaagaggagtgccaagactgtgaaccagctggcccatgccctccaccaggacaagcagctccatgccggcagcctagtgagtgtgatgtggcccaactctaagtgcccacttctgaaggatgacctcgttttgatggacagccctggtattgatgtcaccacagagctggacagctggattgacaagttttgtctggatgctgatgtgtttgtgctggtggccaactcagagtccaccctgatgcagacggaaaagcacttcttccacaaggtgagtgagcgtctctcccggccaaacatcttcatcctgaacaaccgctgggatgcatctgcctcagagcccgagtacatggaggaggtgcggcggcagcacatggagcgttgtaccagcttcctggtggatgagctgggcgtggtggatcgatcccaggccggggaccgcatcttctttgtgtctgctaaggaggtgctcaacgccaggattcagaaagcccagggcatgcctgaaggagggggcgctctcgcagaaggctttcaagtgaggatgtttgagtttcagaattttgagaggagatttgaggagtgcatctcccagtctgcagtgaagaccaagtttgagcagcacacggtccgggccaagcagattgcagaggcggttcgactcatcatggactccctgcacatggcggctcgggagcagcaggtttactgcgaggaaatgcgtgaagagcggcaagaccgactgaaatttattgacaaacagctggagctcttggctcaagactataagctgcgaattaagcagattacggaggaagtggagaggcaggtgtcgactgcaatggccgaggagatcaggcgcctctctgtactggtggacgattaccagatggacttccacccttctccagtagtcctcaaggtttataagaatgagctgcaccgccacatagaggaaggactgggtcgaaacatgtctgaccgctgctccacggccatcaccaactccctgcagaccatgcagcaggacatgatagatggcttgaaacccctccttcctgtgtctgtgcggagtcagatagacatgctggtcccacgccagtgcttctccctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcaggaactgtctgggacctttgctcatctgtgtcagcaagttgacgtcacccgggagaacctggagcaggaaattgccgccatgaacaagaaaattgaggttcttgactcacttcagagcaaagcaaagctgctcaggaataaagccggttggttggacagtgagctcaacatgttcacacaccagtacctgcagcccagcagatagtgggcacctgaggcggagtctgcgtggagaggggcggtgctgccagccctaagtgccatgtgggctcccccaggggcacgtgtggctcctgccccctggccactgccaagagaatgaagcacccagtctcgtaccattttgagccctccagcactacttattttcccccacctttgcctgctgttgctggaagagctggctcatacccccaaaggacactttcagcgacagctatggacagcatggtaccaaggagttaagttgaggctttttccagctttctctggttcatttgattgcttgataaggcctcaggatctcagcattgcacaatgcctcatggaagcctttgagggtatcacacagacacccccaccttcctccagcctgtgcgcacctgccctccttgcagcccagcacacctgcaggtgtaagggacgattggagtttcttcccagagagtctgtcccagaaggactgtggcttgtgtgtgtccatctcgcctgttggctcagtgcttcatcccatttgcagagcctcagacacgtcttggtggtgaggctcagttacccctgggcttaggctgaggcgggccctgtgctgggggtggtagaaaggatgctgctgaggcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagaatgggccgtccacttggcctcgttctgcgaggggctcatgggtctgagagcccccacccactaggcttgattgcatccctgttgtgccctttaagagacatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaatccaaaaaaa

SEQ ID NO: 475 - DNA, 6059 bp, Homo sapien
gggcgggcgggaggcgcggaggcagcggaggctgctcggccgcaaggaggcaggcgggaggccaggggtgcagaattggggcggggggctcccttcacccccgcagccctccgcccgggtccgtgtggccaggcctcacgtgcccgcaggcctggggaaggtggagacaggggcgggggtccgcgcagaggcctgcacggcgcggccaggtgatggtgggcctctgtgtttctccagacgaaaggggacccccggagcggccgtgcccctgggctgcccccgcgaggcgttttgacatcagccatagggaagtcggggagccctgagcctgcctgtttccgttaagtgtccttaggatgcagtgattaaggaattaggctctccctccgggaggggcactgcctgtgctagggaactcgggggcagagaaacaggacaggatgatgctgtccgagcaagcccaaaagtggtttccaacccacgtgcaggtcacagtgctccaagccaaagatctgaagccaaaaggcaaaagtggtaccaatgacacatacactataattcagctgggcaaggaaaagtactccacctctgtagctgagaaaacccttgagccagtttggaaggaggaggcctctttcgagctacctggattgctaattcagggaagtccagagaaatacattcttttccttatagttatgcacaggtccctggtgggtctggataaatttttagggcaggtggcaatcaatctcaatgacatctttgaggacaaacaaagaaggaaaacagagtggtttagattagaatccaaacaaggaaaacgaatcaaaaacaggggtgagataaaggtcaatattcagtttatgaggaacaatatgaccgcaagtatgtttgacttatcaatgaaggacaaaaccagatctccttttgcaaagttaaaagataagatgaagggtagaaaaaatgatggaacattttctgatacgtcttctgcaatcattccaagtactcacatgcccgatgccaatagtgaattttcaagtggtgaaatacagatgaaatccaaaccaaaaaagccttttctcttgggtcctcagcgactctcgtcagcgcattcaatgtctgatttatctgggtcccatatgtcttctgagaaactgaaggctggcaccataggtcaaacacatcttctcggacaccagttagattcctttggaacagttccagaaagtggaagtctcaaatctccacacagaagaacattaagctttgatacttctaaaatgaaccaacctgacagcattgtggatgaaggtgaattgtgtttcggaagacaaaatgacccatttacaaatgtgactgcttcattaccccaaaaatttgcaacactgccaaggaagaaaaatccatttgaagaaagcagcgaaacatgggacagcagcatgaatttattttcaaaaccaattgaaataagaaaagaaaataaaagagagaaaagggagaaagttagcctgtttgaaagagtgactggaaaaaaagatagcagaagatctgataaacttaacaatgggggatctgatagcccttgtgacttgaaatcacctaatgcatttagtgaaaatcgccaggactattttgattatgagtcaaccaatccatttacagcaaaattcagggcttcaaatataatgccatcttcaagttttcatatgagtccaacaagcaatgaagacctcaggaaaatcccggacagcaacccctttgatgccactgcagggtatcgtagtctgacctatgaagaggttctacaggagctggtgaaacacaaagaactccttaggaggaaagacacccacatccgggaactcgaggactacatcgacaacctccttgtaagggtaatggaagaaacgcccagtattctcagagtgccatatgaaccatccaggaaagctggcaaattctctaacagttaataaagccaattgtattgtattgataattggacaaagagagagaaagaaagaaggaaggaaggaaaaacttgttactgaaagagactacactatcaggtttcattacatattctcctttattgtgaagagtagttttacctgtaaatattagcagggactatcaagagtgacctttgaagcaagctaaatcatttaaatgtttaaattgaaaatgggccagattctcaatgaataagtggttccttaggactcactcaggtgctggtactgacccactaatctgccataggcccagaaatatcttcagaagtacgtgagttgttcctcaggaatagatttttcataaagcagaattgatcctgtggctggtttctcagaaatcagtttgtagaaatatttagcttcaggaatactgctcgttataaacactactaaaaaaacagtttatattttatatacacatatgtacatgaatatatatatattcatgtatcttgtatataaaatataggcatatacctcatatatacatgtgtttttagaacatttagaaacaattgattgcctctaaagttaggctaccaatttcttgatttgaaaatgtgtgtgctctattgatgcaagacaagtcatccttcctactgtcatggtttgttatagagaagctgcttcaaatcactcttgactacatggaccttggtttcaaagtgagctgctatatattattctagcatcaaagtttttctctttccccaaaagtgatgatctcaagtccttttttaaagaatgacaaattttaggagacttcattaacttcataacagcatgaatttatttgaattaattaacatttgagtttgtttaaggtataagcagaagataagctaatatagcttgttttgttgaaattctgcatgcctttaaatcactagcaaagcaaatattataaagttatatctgaaaataattgtgggaagtatgtgattgcctggtgtgtctgataacccaaagcagcgggcagattccaggaatgaagaattaggcttggtttcaggttacataaataatagagcagatggttgcctttgggtcttgaaccaaaataagacttactaaaggaagagtgagtttttagaagagaactttacgagcgtgacattatgcattactccacatccaccctttaagaattgatttattacaaaattatgttctattttaaagtccactcccccaaaatactgatttcttccatggattatttttatatgatttgtacaaattttttctgaaatttaagttgacaagcaatgttataaaaatattgctaatcttctgcttatttttcagcctttaaagtctgaaatactataaaacactgagagtatctatgtctttctgaatttaaaatgaaaattcatgtccatatggagacttacatattccccaatctttccatgaattgcatttttttctaatacttatctctgttaagactccattgaaagttaaacaaaaagccgatataatagtttgggttttttttttttgcttattttagtattttgaatcagagaatacttggccaagctcgtatttgtaaactaaaaccccttgttatttgtatcttctgcatttcagttttactgtaagaacatacattttgaaattatgaacatttttttcataaaaattaaatgctttaagaaatggagaaggaaaaatagcttttatcaatttttttctcctcaagattctgtaataaacctcaaagtctggtgtagaatggtattttcccgtttgaggtcttggtagttttttttttttttttaaacatggtgccacttttaattaactaaatgttacaaaattctcagcatttgtttttgtctggtagtattattgagtcttttcatacacttcttaaaatgtgaaaatctatgttttcagtattatgacagtatctgcagatactataataatatgctttggccaaatttgctgtttatagagtgaaccaagatgtcagttttgtattggggatatgttttacataaatagaactcatttaaaagtatggttcaagtactgctcttctttttatggggaaattgatttttaaggagcgattcttttcctatataaaagctattgaggcttagctttattcatacatgagtgatttggttataactcaatcaaaatttttatctttaaatctgagacaagtattatatttaaaactagatctattaatacattcatcactgcctgaaaatttgctgttctaatgtttgtgaattttcactcattacctagagtaaacttattgcatattttcataatcagtcaaaataataaaactaaaaacaaaaagtaaaaattagttcccaagtaaatatatcagtgtttcctgtgtttgggcagaagtgcaaagtagttttaatttctcacgttgtagaaaaagaggccaaaaaggtcaccttagtttatttttccaaaacataactttaggtattctaatgtattttgttagttgcttagaaatggaaataaaatatatgtgcttattaaataatgcacagtacactagattatagagtttatttttgcttttatgctttaaagaatgcatgcccaaaacactactaccaacaggaggattttttaaaatcacagaattgatatttatctcaagactatcttaagctaatgtacttctgttacataattaaactatttctgctattatttttaaagcagtattattttataaccaattctaaaattcagctttaaaaatattgaacataccttcctaccacttacgcttcaagtttcatttattgaataccagggtcatatcttagaattgtatataaaacaacatgtaacccattcatgaaaaacgtttttaagtattgctttttgctgctatgttctgcattgagcctagttttgccattgtcccctgaatgtagtattatctatagattatacataactacatctattgcttttggtggtaaatcaagatttagttgtaattttccagctgtgaaaatgttgccttgtatttaaaagggtttcatgaatggaaacctaagtaaaactaagctcattagtgacagacttgttttcttcttgttattcctccagcaactccctcaccaccacgcctccctgcctaccatccccggaagggtgcttattctttaacaaagagaatctaaaaaaaaaaacaaaaaactgttgtctaatatatctacagtaaatgttacactagagcttttattttcctctgtagcttttcagaagaagcaatttaccttggatttgtaaatcaagctgaaacttttttgatgttcatgtactcatatgtcttgtaggtggtaggtgtcacttgtgtgtatgtgtaagtgaagtatgatgcatgctcattcacttggtccctttgaaataagggaaaggatcacagtgctgctgggccatgatggtatgtagaagggtctgtcagcacacatggaaagcccccatttgcacagatgtagaactttaataatccagatgcaatcattggaagtatttaatatgcaattggtagcaccttagctaattaatctgcatatgaagcattttctgatatatttaataagaggtatagaagctcttcaagcattaaaatagagttgatgtttcattccatttgttttatccatcaaaaaatgcactctcacagtggagttgaagtctaatacatgatacatgtgggcctgttagtcttcgaagcttccagatggtttgtgttttgaggtacaaaaaaatgctgcagatctagaaatgcatatatttagcgggtatttgaaagatagaagcattatttataactgaagagtataacacttatcttcttaagtaaatgctctcataacttgtatacatttttgcaggtacaaattcaaaagtatgtaagcattgtataatgtgacaattgtataatttatgtaatctgatgcatgaatcagaatttttatataatatatgattattgacttatagttgattaaagtgtttaaactt

SEQ ID NO: 476 - DNA, 8089 bp, Homo sapien
tttttttttttttaatccccgcaccaagcgcttaacctcattggggtggaggagaaggcggcggctctctggtccgcagcggcaacagtaacgaaaaacagggctaatggactgctgaattatgaagtatttcagacccagtagtagaacatcactctgccactcactcctttatctcctactagttatttaaattggacttttaatatcctaccagctgctcttcagacacacatggtgcattgttgccattccccagattgcatctttgaaacacaggctcttagtaaccttcagcgaacaaagaggcaacctcccagatacgtctgctgggagggagtcatcgtgactgccctctagcttttgctggatctggatttgaattccactatggagcctcgcatggagtcctgcctggcgcaggtgttgcagaaggatgtggggaaacgattgcaggttggccaagaactgatagactatttctcagacaaacagaagtctgctgaccttgagcatgaccagaccatgttagataaacttgtggatggacttgctacctcttgggtgaactctagcaattacaaggtggttctgctgggcatggacatcctgtccgccctggtgacccggctgcaggatcggttcaaggcgcagatcggcacagtgctgccaagtctaatagacagactaggagatgctaaagactctgtgagggagcaggaccaaactctgctgctaaagatcatggatcaagctgctaatccccagtacgtatgggacagaatgcttggaggcttcaaacacaagaatttccgtactcgagaaggcatctgtctctgccttatagcaacactcaatgcctctggagcacagactttaacactaagcaagattgtgccacatatatgcaacttacttggagatccaaacagccaggttcgagatgcagcaataaacagcttagtggaaatttacagacatgtaggagaacgtgtgagggcagatctcagtaaaaaaggattgccacagtcccggttgaatgtaatttttacaaaatttgatgaagtccagaaatctggaaacatgatacaatctgcaaatgataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcggtctcaggtagtgcgggaggcttgtatcacgttggggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttaggtcggatccgcacaagacggcaaagctctgggagtgccaccaacgtcgcctctacacctgataaccggggccgcagtcgcgctaaagtggtttcacagtcccagcgatccagatctgctaatcctgctggtgctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagcacggagcagccgtatccctcgacccagcatgagtcaggggtgcagccgcgataccagccgtgagagcagccgagatacaagccctgctcggggctttcctccacttgatcggtttgggcttggccagccaggaagaatacctggttctgtgaatgccatgagagttctgagcacaagtacagatcttgaagctgctgttgctgatgctttgaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgagtcgagttgaactgaaaaggttgtgtgagatcttcactcggatgtttgctgaccctcatagcaagagagttttcagtatgtttttggagactcttgtggattttataataattcataaggatgatttacaagactggctttttgttcttctcacacaattacttaagaaaatgggagcagatttacttggatctgtgcaagcaaaagttcaaaaggctctagatgtcacaagggactcctttccatttgatcaacaatttaacattttgatgagatttattgtggatcaaactcaaactccaaacctcaaggtcaaagttgcaatcctgaaatacattgagtctctggccagacagatggatccaacagattttgtaaactctagtgagacaaggcttgctgtttctagaatcataacctggacaacagaaccaaagagttcagacgtgagaaaggcagcacagattgtgctaatctctctgtttgaattgaatactcctgaatttaccatgttacttggtgccttgccaaaaacattccaggatggtgccaccaaactcctgcacaaccacctcaagaattccagtaacaccagtgtgggctctccaagcaatacgattggccggacgccctcccgacacaccagcagcaggaccagccccctgacctcacccaccaactgttcccatgggggtctgtctccaagtcggttatggggttggagtgccgacgggttagcgaagcacccacctcccttttctcagcctaactccatccccaccgctccctcccacaaggctctcaggcgctcttactctcccagcatgctggactatgatacagagaacctgaactctgaagaaatctatagttctctacgtggagttacagaagccattgaaaagtttagttttcgaagccaagaagatctgaatgagccaattaaacgagatggcaaaaaggagtgtgatattgtgtcccgcgatgggggcgctgcctcccctgccactgagggccgggggggtagtgaagtagaaggaggccggacagctctggataacaagacctcactactcaacacccagcctccgcgcgccttcccggggccgcgggcgcgagactacaacccgtacccctactcagatgccatcaacacctacgacaagaccgccctgaaagaggctgtgttcgatgacgacatggagcagcttcgagacgtgcccatcgaccattctgacctggtggctgaccttctgaaagagctgtccaaccacaatgagcgagtggaggaacggaagggagccctgctggagctgctcaagatcacgcgggaagacagccttggtgtctgggaggagcacttcaagaccattctgctcctgctgctggagacccttggagacaaagaccattcaattcgagcactggcgttaagagttttgagggaaattctgagaaatcaaccagcaagatttaaaaactacgccgagctgacgattatgaagactctggaagcccacaaagactcccataaggaggtggtgagagcggctgaggaggctgcgtccacactggccagttccatccacccggagcagtgcatcaaggtgctctgccccatcatccagacggccgactaccccatcaaccttgctgccatcaagatgcagaccaaagtcgtcgagaggatcgcaaaggagtcattgctgcagctccttgtcgacatcatcccaggcttgctgcagggttatgacaacaccgaaagtagtgtgcgtaaggccagcgtgttttgcttagtggcaatttattccgtaatcggagaagacctgaaacctcaccttgcacagctcacagggagcaagatgaagctactaaacttatacataaagagggcccagaccaccaacagcaacagcagctcctcctccgatgtctccacgcacagctaatggcagtacctgtctcttgtgtagacctagaagcaatcggtggtgcctctcagagacctttccccacccccttcatcggctgcccagtcagtacaaggaggcccacaaatatttattacaatcagtattttggtcccttccagcttttctgtagaatcttactggtattgaatgtaaaggaagcaaggcctgtattgcagtcttcatacaaaacaaaaggaataagaacagaaaagagccatactgaaacatgtcttgtacagcctgctgagatggcgaaaccctgtgtgtggggtgcagtttttaaaaatcagagcgctctagccactacttggtagaaagtagcattttttttttcagttaataacatatttgggggtggggtggggtgttactttgtgttcttcctccttagcctattttcttgtgcgtatggtctgtgtggggcccctttcacagctgacaccacgaaaggtgatatatctttaagttgtgttctgagacctactaaaaatgggaatcaagtcttggcaagaacagtctgaagatggccttttaacaaacgctgggaattttgcttgtcatatccagactggaggccgactgccctggctttcagcgtagaattgggagtgcaccctgacagtctccttccagctctccctaatcgactccaccgacaaggtccctaccccagagcttccatgcaaaggaattcttcaagtttaaatctggacacaaaaataagataaatgtatggcatcatttagggatgcctgagatggcagttcatgaagcacagaagataaagaagaagtctttcatctttactgctgagatccttgggaacactgttgtcatgggggctctgccaagaccctcatctctgggctacacggtgattcagattgagcaccaacttgtttcctcccctcaaagttctgcctaagccgttcagttctaacatggtctcagttaatctggtaaatggcatctttaccatcttagttctgacttctcagtttaatgtgggattaagagccaagaaaagcctagagagactggatatcacaattttttttaattttataaactgaagtagttccttgaatgtctgttgatgaaatagtcactgtttaaggaaaaaagtaattatgaggtgtagcagattgcagaaaaacaggattagaaacacacttaaaaagaacacacatttagagtctctcttcctcctcagcgaaccactaggcccccttttttaaaaacacctttagagcctaattactccaataaaagtaactagaggtttggagtctggttaaataaattctgagtaaaattcttaagccaaatggaaattcttaatgcaatcatgaggacttctattgtctcttactgttgtattagatcctataaattgaactgatttttccataaggaaaatgcttcttttgagattaattctaataacgtatttgctattgcagtgcagagcccactgcaactgctaggactgaaagcagaggctgggtgccagagcacgtgattcttaacatcatttccacagacccctctgccctgaccctctgcattggatgcaggaagctgggaaagactgatgttgatttggaaacatgggctgaaaatgaaggccccatagtgcataggaacagtaaagccagggtgctgacgtgtgtgtgtgtgtgtgtgtgtgtgtgtgtgtgtgtgtggtgttgtgtgtgtttgtgcgtgcaccctacacatgtgtggtacctcactgctgctgtttagggaacttgagggacgcgtttcaaggggttgggtattactgacgagctttggctcaaaatatagcaggaccaggtcttttgttgataagtactgtttgtttattaatatgtcattaatggtatttcttttttacactctacaagtgaattagggagtctcttgttgacccctttgttgcaggaatgtgcgtcgggctaggttatccatgagtttctttattcctaatgcagttagaaagacctttctccttgagctctttgactcccagaaggtaccccagtccccagtgtacttagaaaggatctcgaacattgctggacgtcctcatagtactcacaaagggctagccttgaatgtcactcgcccagtcttcagtctcctgacttagagatacaatcacgtcacaggtctcttggcctcaatctgaaaactgctgccgccgcgccgaggagactcgcatgccgccaccacctcactgggagggcgccgagcccaccgtcgccccctagaccctgacagctgcagctgccttgccttgccgccgcctccctgcagggcccctgttccaatgaaaaacagaacacaaaagagcagagcacctaagcctgtctctgcctccctgtctaccggactggccagggcccaagacccccgctgctccactgcggggctgggcgggctgactccctgcttcctccaagctgctgcctcccctgcagccagggtctgggcagggtgcagccggtcctcggggcacgcagcttccttcaagtacactgtgtgtgcttcccggacctgcggcgatgccacgggcctgccttttctatgcgcctcactagcttaccaccctgtgcaggtaatgcaactgactttgtctcatcagtctttttctttccctgccaccctttatttatcaagcgtaatgttacactttaaaggacagcaaataagaactttgtagaatcccaccaggactttgctaacaataatgtttggaaataaagaagtgctctgaaaaaatatcagccaccaaaatagttatgttggcactgtgttcacacgcatggtccccacacccccaggttgggtgggtttttttgttttttgggtttttttggggggggggctttttcatgttacatccatatctgtatttatatcttatttgtttcactttcaagtgtatcatggcaaatgtacagatttttttgttaataatgtgctaggatttgctaaaaaagaaaaaaaaaaaacccttttgagtttgccctagaataaatgagacttaatt

SEQ ID NO: 477 - DNA, 1201 bp, Homo sapien
gcaggagcaagcgtctgccgcggtggccgggtgccgatttgacaagatcaaagctgcaggaaaatggacagtgaggttcagagagatggaaggatcttggatttgattgatgatgcttggcgagaagacaagctgccttatgaggatgtcgcaataccactgaatgagcttcctgaacctgaacaagacaatggtggcaccacagaatctgtcaaagaacaagaaatgaagtggacagacttagccttacagtacctccatgagaatgttccccccattggaaactgacgcttggctcctttcttgtggatggattttctcaaagtacacagataaagcacggtttgtttcagtctccaaattcaaacctttgagtaataaatcagcactcaaaaatgtacacccatttagtttgtggtagcaaagtgcaatgcgaaattgaatgagaaactgagatttctcagtaatggtgaatatttcgctctttaaacctaaaactcttcattgagtagcttatatttgaacatgattggttaaacatttgcctctacctctgattttgctttgctgtcaaagtttaacaccttccaactacttatgtgtgtcctgtaacacaggtgattgaacgtatgagagggaaaggcaaagaaaaaggaagccagacactaggagaattattaacttctcatacttccccacattgagaagcattcggagtgtatttagcctgtagatgttgtgatatgcaaatatcccattccctggttactggcattcctaagattcttcatggtattttcaaactttggataaatttacagattagaaagatatctgacagttaatctctgttctccttacaaattccttttgtgctgctggaaaggatctttggctaggtggatgactagttttattcaaagccttttctcaaagccctttcagttacaaccaccccactatggaatcagtatttagttatacatttgtataagaacctgtattttgaaaaacacattcatgtatatttattcctggaattatttgcctgttaaacagtgtctttcatgttctctccccagattgtaaactctgtaagaagctgcttgtatctgtatcccttgttgaaactctgaaaacactgaataactaaaatctcttctcatccttacaaaaaaaaaaaaaaaaaaaaaaaaaaaaa

SEQ ID NO: 478 - DNA, 2762 bp, Homo sapien
ggggctctgtggcggagacagccaggttggcagctgacgggacagccggggtctattttgttgcgggttttcagcaaatccagggctggtctggaggcgcgaaaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaagactttgcataaaaaaactttctactatctggaacagttaattctgaaatatggaatgcatcagaatacacttcgtatcaaagagattcatgatggtctggatttttattattcctcaaaacaacatgctcagaagatggtcgaatttcttcagtgtacagttccctgtagatacaaagcatcacaaagactgatctctcaagatatccatagtaacacatacaattacaaaagcactttttctgtggaaattgttccaatatgcaaggataatgttgtctgtctgtctccaaaactggcacaaagcctgggaaatatgaaccagatttgtgtgtgtattcgagtaaccagtgccattcacctcattgatccaaacaccctacaagtggcagatattgatgggagcactttctggagtcaccctttcaatagtttatgtcatcccaaacagctagaggagtttattgtgatggaatgcagcatagtccaagatataaaacgtgctgcaggtgctggaatgatatcaaaaaagcataccctcggggaagtctgggtacagaagacatctgaaatgaatacagataaacagtatttttgtcgtactcatttgggacatcttctaaatcccggagacctggtgttagggtttgatttggccaactgtaacttaaatgatgagcatgtcaacaaaatgaactcagatagagttccagatgtggtattaatcaagaagagctatgaccggaccaaacgtcagcgtcgtagaaactggaaattgaaagagcttgcaagagagagagaaaacatggatacagatgatgaaaggcaataccaagattttcttgaagatcttgaagaagatgaggcaattcgaaaaaatgtcaacatttacagagattcagccatccctgtggaaagtgacaccgatgatgaaggagcacctcgaattagtctggctgagatgcttgaagaccttcatatttcccaagatgccactggtgaagaaggtgcatcaatgctgacataatgagatgttgtagactgtttccatacatgggcttaagaagttggacagagttaccttaagtgtctctactatctttgcctccagatttcaagaggagaaatttagttttaaacctgaataaacatgtttgttttcagtgctcactcaaaccactaaaacagatggatagctttgaggttttagataaggaaagattatggagaatgtagttgttattgatttttggcaattttacatttggaattttatcactgtgcttttttatatgaggcactgtagtattttcacatagtatagtactctggatgtaaaagctcaaaaattgtgattccttgaacgttcactaaatcttcaagcaaaaacacatttttacattatttttacgttgattattttagtgaaagaccatatgaagaagcatttttaatattaacttgttacatactttgatccactttacatcatttttatgttgttgaggtagggaaattagggttcagtttatcactggacattcaggaggcaagtcaatcttttttatttccttataaaattaactcttcaaaagccgttaaacagagagttatcttaatttttattgcagtaggaggaaatatatttaaaatatttgtagatttatagcaaatagagactcgttatttaaaggttaaataacaatttgttcttttgttgtttttgccagtttagggcagtagctgcttttgtcataaatatcttcctaccacatcaaaaatgctgcttttaaaatttttgtttataaattgagaaggaattttctctctataagtttctgtcattgaacagatcaccattaaaaagaatattagaatccagcatgaagataatggctaataaaaatgaggtacatactttataaaaccattaatcagatttgaatgaggaatgcttcccacatccttgaaagaaaaactgtggcttacgttttgaagtattctgagaatgaagtattaagatccaatttctataagcaagatcagacttgttaagtatgccgcaagtaagagctaattcattcattccatgtgtgccactaaataaagagattgagcaagtgcaaaaaaaaaaaaaaaaaaaaaaaaaaaaaa

SEQ ID NO: 479 - DNA, 1877 bp, Homo sapien
ccgcgacggcgcgcccccggcggctgctgcggcggcgggagcgaggcgaccgctgaggccgcggagagtgacggcggcccggccgacgggagccggggcggggcggcggcccagcgaaggagcgcgcgggcggtctggccccgccccctccccgcccgccttcccggtgaccttcaggggcccgggtggcgggcgcaggcccctgcggcggcggcgggatgttcgtgcaggaggagaagatcttcgcgggcaaggtgctgcggctgcacatctgcgcgtccgacggcgccgagtggctggaggaggccaccgaggacacctcggtggagaagctcaaggagcgctgcctcaagcactgtgctcatgggagcttagaagatcccaaaagtataacccatcataaattaatccacgctgcctcagagagggtgctgagtgatgccaggaccatcctggaagagaacatccaggaccaagatgtcctattattgataaaaaagcgtgctccatcaccacttcccaagatggctgatgtctcagcagaagaaaagaaaaaacaagaccagaaagctccagataaagaggccatactgcgggccaccgccaacctgccctcctacaacatggaccgggccgcggtccagaccaacatgagagacttccagacagaactccggaagatactggtgtctctcatcgaggtggcgcagaagctgttagcgctgaacccagatgcggtggaattgtttaagaaggcgaatgcaatgctggacgaggacgaggatgagcgtgtggacgaggctgccctgcggcagctcacggagatgggctttccggagaacagagccaccaaggcccttcagctgaaccacatgtcggtgcctcaggccatggagtggctaattgaacacgcagaagacccgaccatagacacgcctcttcctggccaagctcccccagaggccgagggggccacagcagctgcctccgaggctgccgcgggagccagcgccaccgatgaggaggccagagatgagctgacggaaatcttcaagaagatccggaggaaaagggagtttcgggctgatgctcgggccgtcatttccctgatggagatggggttcgacgagaaagaggtgatagatgccctcagagtgaacaacaaccagcagaatgccgcgtgcgagtggctgctgggggaccggaagccctctccggaggagctggacaagggcatcgaccccgacagtcctctctttcaggccatcctggataacccggtggtgcagctgggcctgaccaacccgaaaacattgctagcatttgaagacatgctggagaacccactgaacagcacccagtggatgaatgatccagaaacggggcctgtcatgctgcagatctctagaatcttccagacactaaatcgcacgtaggtggcgttgttccactcggctatcaggccacagcagccccctggtgcggcccgagaccgggcagagtggacctcacctggaaactcaccttcagcgcctcagccctggactgttagaggtgctgcagctgctcctgctctctgatcttattgcttataaactttggtgacggtagtgtgtaaggccgtatttttagcatctgacaggtgtttacaaaaaagtggttgtcgcactgggaagtggagtgatggcctcgtctccagtgctcctctgggctcttgagttgctgcttgaattgccgtgtagacatttgcttggagagtccacttgttatttgacggaggtaggtttcaacccagagttaatgtcaagcatgctaatttaactagtcactcacagatgacttttctttaataaagtcccttttcctaaaaaaaaaaa

SEQ ID NO: 480 - DNA, 3566 bp, Homo sapien
gccgtgcgccggttgctatacaggccgcacttcacaccccgtgcctccccgcctctcctggctcctccgcccagatccccggcgctcccgcgttcggtgacggccgggtaggctgtaggcagcgcaatgccaagacagagctgctggcggcggcgggcgaatctccctgcaccatgagcctcggctccggccccgttaggggccgataagcacagcgcacgccgccctccatttgccccggggcctcggctgcgaagatagcggcggccggacaggaagctcgaggaaagcgctgggccgggtctctacgaacacgtgaaggaaaagcagctccgtccacaacgccgcttcggggctcctagggagtcgggccccgggccgccaccgtcacctcggccgctgccgctgtcgccatcgccttgtttccccatcccccgccatggccgaggacctctctgcggccacgtcctacaccgaagatgatttctactgccccgtctgtcaggaggtgctcaaaacgcccgtgcggaccacggcctgtcagcacgttttctgtagaaaatgtttcctgactgcaatgagggaaagcggagcacattgtcccctatgtcgtggaaatgtgactagaagagagagagcatgtcctgaacgggccttagaccttgaaaatataatgaggaagttttctggtagctgcagatgctgtgcaaaacagattaaattctatcgcatgagacatcattacaaatcttgtaagaagtatcaggatgaatatggtgtttcttctatcattccaaactttcagatctctcaagattcagtagggaacagcaataggagtgaaacatccacatctgataacacagaaacttaccaagagaatacaagttcttctggtcatcctacttttaagtgtcccctgtgtcaagaatcaaattttaccagacagcgtttactggatcactgtaacagtaatcacctatttcagatagttcctgtgacatgtcctatttgtgtgtctcttccttggggagatcctagccagattaccagaaatttcgttagtcatctaaatcagagacatcaatttgattatggagaatttgtgaatcttcagctagatgaagaaacccaataccaaactgctgttgaagaatcttttcaagtaaacatctgaaggctgtagacatctctgcatctttgtacctgcaagtgccatctttaagggggaaactacatgaagtcaccgttacagtaacttgatgtgtatattaataaaagtaattcagtcattttagtttttgattgaaaataaaggtagggcttctaaaaacttcatcatcttgataagttaaaaaatgaaagttatgacattagctttaaaggtgtaaaaaagatgtttcactaatgtaacggtgaaagagaatccctgttgtactttatctttttgtaatattatttttgaatttttcattattatgttgcttttgaaatttgatgcattcctcccatttactttattattgtacacatttaacacacagtagcaaattttgaacgatgtgattgatataacctaacaaatctgagccagttattattagagttgcagaatagaaacttgaagtgctaaatggaataatccaaaggaaattttttaaatgcaggttctagctgaaaaattcaactataagaaaattgtatttatataacatttactatttttgaagactagtgagatttctgtaataattttaattctttaaaaagtgaaagcttgttgtaaagatattttctttttgttattagaaggaaatacaaagagaaaaatttctttctttcatgggcatttgataatttcagtctttgactgatttgtaagcctagaatatactaagctgaataacagctctttggcctcagaattttcagtagccagtatttctgattaactaagttgaaactcttattagaaactttcagttggtgatattgtattctagaagatataaatgagaggtttggcttcatctcagtttagaaatttattcaaagctaaagatgtatatatacatatacttttgtgtgtatatatacacatatgtgtgtatgcagtttgtcaggttatatatagaatttctattaaggattttttaaatggacaagcaatagggggttgaagtgtttatctgatttgtttaaaattttgtatatcaccaaatttttaaaaagtgatagtcacagtgctaagttatctagttggctactattacaccttaaaaattgagtttacacacacacaattacctgtttatatggtgctcatttgttattctcaaatataatgtgtgaccgtgatatagtgagaaagattctaccaaccactgtttcactactttttagttaaaattgggtatgttcttaatattcattagtgagaatcacaaagtattttgtagaaggcccaaatcacagaataaaggactaagagtggatttgctgacattccatactaatatacattgtttatgctttctttaaaataactagaagaacataaaagaaagagaatctcagaagtagtttgctgctaatatatacatatattgtataaaaaggtatattttggttttgttaaaacccttgttgacttttctacactgaacattttttttaacttgatttaataaaaatgttaattttggaagtgcagttttgtaaaaacctttttcagtcaaacagtaaagactttatttatggattgtaataacaaccacaagaaaagccatacatcttaatgaacatacgcctttgttctgtcattttaaagagtggtgtttactatgtgtgtgcttgagcattttctttcagttacatgggtgtaatttaaaaaacagctcctttttaagacttttgaccatagtgttttccagtttaaagcaataactttcatagtttctttcaaagtttaatacatccaatatgtcaagttaaaccattctgggatttgcaaagtttaatacatccaatatgtcaagttaaaccattctgggatttgcaaagtttaatacatccaatatgtcaagttaaaccattctgggatttgggaacttctttaaaggaaaattgtagtagaggtcatcttgatggaattgtgttttaaagttttgtgaatgagttaaatatcattgatagtcttgtgtgtctcacatatcagctttttcataaggaaaatactttatttgcttttatctgagaatttctcagtatgaaaatgattgtttaaaatttcccctctttttgtcagtgcattgggaatagggatagactttacagatttatggaaattaaatttatggggaaaagtttatttttaatattacttatagctgagtcagaattaaaggagggaattgtattgatactccaatacctaaatttcacaataccacttaggaaagctatttcaacaaattacagttttattgttaaaacagagtcttatttgagatgtattgctttatttttcaattaaaagtggttttctcctaaaaaaaaaaaaaaaa

SEQ ID NO: 481 - DNA, 3023 bp, Homo sapien
ggcgggacaaccgcggcgcggctcggcgctcccggcctggcgttgtggcgccgcagcccttgccaccttccctgcacctgccctgcccggcctcatgtaccgcgcgctgtacgcgttccgctcggcggagcccaacgcgctggcgttcgccgcgggcgagaccttcctggtgctagagcgaagcagcgcgcactggtggctggccgcgcgggcgcgcagtggtgagacgggctacgtgccgccagcctacctgcgccgcctgcagggcctggagcaggatgtcctccaggccattgaccgggccatcgaggctgtacacaacacagccatgcgggatggtggcaagtacagcctggaacagcgtggagtcctccagaagctgatccaccaccggaaagagaccctgtcacgcagaggcccttcagcctccagtgttgcagttatgacctcatcaaccagtgaccaccacttggatgctgctgcagccaggcagcccaatggggtgtgtcgagctgggttcgagcggcagcacagcctacccagttctgagcatcttggggcagatggaggcctctaccagatcccacttccatcttcccagatcccaccacagcctcgccgagcagcacccaccacaccgcccccaccagtgaagcgccgagaccgcgaggccctgatggcctctgggagtggtggccacaacaccatgccctccgggggtaactctgtgtccagcggctcctcagtcagcagcacctccctggacacgctctataccagctccagcccatctgaaccaggctccagctgctcacccacacccccacctgtgccccgccgaggcacccacaccaccgtgtcccaagtccagccccctccctccaaggcatcagcacctgaaccccctgcagaagaagaagtggcaactggtacaacctcagcctctgatgacctggaagccctgggtacactgagcctggggaccacagaggagaaggcagcagctgaggcggctgtgcccaggaccattggggccgagctgatggagctggtgcggagaaacactggcctgagccacgaattatgccgggtggccatcggcatcatagtgggtcacatccaggcctcggtgccggccagctcaccagtcatggagcaggtcctcctctcactcgtagagggcaaggacctcagcatggccctgccctcagggcaggtctgccacgaccagcagaggctggaggtgatctttgcagacctggctcgccggaaggacgacgcccagcagcgcagttgggcactatatgaggatgagggtgtcatccgctgctacctagaggagctgctgcatattctgactgatgcagaccctgaagtttgcaagaaaatgtgcaagagaaacgagttcgagtctgtcctggccttggtggcctattaccaaatggaacaccgagcatcactgcggctgctgctcctcaagtgctttggcgccatgtgcagcctggatgcagccatcatctccacgcttgtgtcatccgtgctgcctgtagagctggcgagggacatgcagacagacacgcaggaccaccagaaactctgttactctgccctcatcctggccatggtcttctccatgggagaggcagtgccctatgcacactatgagcacctgggcacgcctttcgcccagttcctactgaacatcgtcgaggatgggctgcccttggacaccacagagcagctgccggacctctgcgtgaacctgcttctggctctcaacctgcacctgccagctgctgaccagaatgtcatcatggctgccctgagcaaacacgccaatgtcaagatcttctccgagaagctgttgttgctcctgaacagaggggatgaccctgtgcgcatcttcaaacatgagccacagccaccacactctgtcctcaagttcctgcaggacgtgtttggcagcccggccacagctgccatcttctaccacacagacatgatggctctcattgacatcactgtgcggcacatcgcagacctgtcaccaggagacaagctgcgcatggagtacctctccctgatgcatgctatagtccgcaccacaccctacctgcagcaccgccaccggctacccgacctgcaggccatactgcgacgcatcctgaatgaggaggagacctcaccccagtgccagatggaccgcatgattgtccgagagatgtgcaaggaattcctggtgctgggggaggctcccagctagcaccttgctgtcctcccttccctgcagctccagtcagtgtgcaggggactcaggggcttggccctaagaatgttttgcactgacagtgggaggggataaggtggcagaaggaacctgagcaggacccccacctgaagtagaacttaagagaggggccaagtgtaggattggggaccatggtctgggagctgttctggggcagggggaatatgcaagctaaagcccctctataccctggtaggcttcctcttcagcatgcccccctcttcaccccacacccatgtgtacactcagagtcctgctgccgctccaggctggaccagacccccatccccacccctcctggtctgtatcctgggcctcagcaagccatgcccctggggtgaggggaggcatctcccaccagctctattctttgccttagctttgcagtgagtgctgctcatgtcctcccctccacccgcacatgggggtcgctgcccttcactcctacccccagaggccttggccaagctgctgctttgaaagcgggatcttggagacaggccatccatcctggagcctcatggaacaggatgatggcactgagaaagccaatgaccgaatctcttttctctgtaaaaatgtagactgaaaagccatgtgtattttcctatgtgctgtagctctcctttggaaataaatcacaggcatctggaaaaaaaaaaaaaaaaaaaaaaaaaaaaaaaaaaaaaaaaaaaaaaaaaaaaaaaaaaaaaaa

SEQ ID NO: 482 - DNA, 2442 bp, Homo sapien
gtgaaaggagggaacgcaggtgagaaagcgagacaggcaggtagggaaatcgtgaggtgagcgtgatcctagctccttgtggcagagcctagagagaaggcgaggacgctgaagaaccaggcggacagctggcagagagagaagttggctagcatggaatcaccagaggagcctggagcatccatggatgagaactactttgtgaactacactttcaaagatcggtcacattcaggccgtgtggctcaaggcatcatgaaactgtgtctagaggaggagctctttgctgatgtcaccatttcggtggaaggccgggagtttcagctccatcggctggtcctctcagctcagagctgcttcttccgatccatgttcacttccaacctgaaggaggcccacaaccgggtgattgtgctgcaggatgtcagcgagtctgttttccagctcctggttgattatatctaccatgggactgtgaaacttcgagctgaggagttgcaggaaatttatgaggtgtcagacatgtatcagctgacatctctctttgaggaatgctctcggtttttggcccgcacagtgcaagtgggaaactgccttcaggtgatgtggctggcagatcggcacagtgatcctgagctctatacggctgccaagcactgtgccaagacccacctggcccagctgcagaatacagaggaatttctccacttgccccaccgcttactcacagatatcatctcggatggagttccgtgttctcagaacccaacagaggcaatagaagcctggatcaactttaataaagaggaaagagaggcttttgcagagtcactcaggacaagcttgaaggaaattggggagaatgtgcacatttacctgattgggaaagagtcatctcgtacccactcgttggctgtgtccttgcactgtgcagaagatgactccatcagtgtaagtggccaaaacagtttgtgccaccagatcactgcggcctgcaagcatggtggagacttgtatgtggtgggagggtccatcccacggcgcatgtggaagtgcaacaatgccaccgttgactgggagtggtgtgctcctttgcctcgggaccggctccagcacaccctggtgtctgtgcccgggaaagatgccatatattcactgggtggcaagacactgcaagataccctctccaacgcagtcatttattatcgcgtaggtgataatgtgtggacagagacaactcagctagaggtggctgtgtcaggggctgctggtgccaacctcaacgggatcatctacttactagggggggaggagaatgatctggacttctttaccaaaccttcccgactcatccagtgctttgacacagagacagacaaatgccatgtgaagccctatgtgctgccctttgcaggccgcatgcacgcagctgtgcataaagatctggtgttcatcgtggctgaaggggactccctggtgtgctacaatcccttgctagacagcttcacccggctttgccttcctgaggcctggagctctgccccatccctctggaagattgccagctgtaacgggagcatctatgtcttccgggaccgatataaaaagggggatgccaacacctacaagcttgaccctgccacttcagccataactgtcacaagaggtattaaggtgctgcttaccaatttgcagtttgtgttggcctaaggctgtggggaggggaggagaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattaggtgttaagagttttccttcaggctttacttaggagaatggactaagctgaaggtgtacttcaccagcaagagtcaactctagaattcaggatgttccttctattgttttcttagccatctgtcaggaaatgtaactttggttttatttttggcttattccaaggggtaagccagaaaatagaaatgattatttctgattaatagcagaaactttttcaatctcaaatatataaggtgtctgctcttttaaaagctctaagctaagtcaagagctaggaactgttgatacaaataaaagtttttgaaggg

SEQ ID NO: 483 - DNA, 3256 bp, Homo sapien
cggcggcggcggcggcggcggcggcggcggagcccggagcgcaggccggaggctcccggcccgccggccccggagcggagcggagcggaggatgcagcagccgcagccgcaggggcagcagcagccggggccggggcagcagctggggggccagggggcggcgccgggggccgggggcggcccaggggggggcccggggccggggccctgcctgaggcgagagctgaagctgctcgagtccatcttccaccgcggccacgagcgcttccgcattgccagcgcctgcctggacgagctgagctgcgagttcctgctggctggggccggaggggccggggcgggggccgcgcccggaccgcatctccccccacgggggtcggtgcctggggatcctgtccgcatccactgcaacatcacggagtcataccctgctgtgccccccatctggtcggtggagtctgatgaccctaacttggctgctgtcttggagaggctggtggacataaagaaagggaatactctgctattgcagcatctgaagaggatcatctccgacctgtgtaaactctataacctccctcagcatccagatgtggagatgctggatcaacccttgccagcagagcagtgcacacaggaagacgtgtcttcagaagatgaagatgaggagatgcctgaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggctgatgaaggagctcagggatatataccgatcacagagtttcaaaggcggaaactatgcagtcgaactcgtgaatgacagtctgtatgattggaatgtcaaactcctcaaagttgaccaggacagcgctttgcacaacgatctccagatcctcaaagagaaagaaggagccgacttcattctacttaacttttcctttaaagataactttccctttgacccaccatttgtcagggttgtgtctccagtcctctctggagggtatgttctgggcggaggggccatctgcatggaacttctcaccaaacagggctggagcagtgcctactccatagagtcagtgatcatgcagatcagtgccacactggtgaaggggaaagcacgagtgcagtttggagccaacaaatctcaatacagtctgacaagagcacagcagtcctacaagtccttggtgcagatccacgaaaaaaacggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatggatttttaatttattttctcttatttcatgtacactgctttttttggttacagtgtatgatggatgtgtatgaaaaaaatgtatctttgggaaaacaattacagtttgttaatttgaagatgctggtcttgactcatctttatttttattcgcacatcccaccccatcccctgaactacttgggaggtggggaggggtacgagtccactgttgctttggtagagatgagaggccgcattttgctgctaaagcaagagaaacttggagctgaagcacacacctggtctgcccctagatttctcctcaaggcctctggagcaaccagcacttgcccccttggaatgcagagcctggcctgccaaactacaatgtggtaggctgaaacgatggtgttaattcttaggactacttttctagtcacagatgttttcaaatttctaagaaaaagaaaatgaggctcaagaggctgcttcgtagaattccttttgaatgaattgagtggggatggggacacagtctccaagtgtgtatgtggtcttttctgatctcagctgtgtggctgcaactcttcgctgttcattggttcctctcctggaaagtggcttctaaccagcactggatggtgatcattggtaagctttgctcacctccctctctcttgcttcatttggctttatcaaaaagaacagacctagctctgaatttgtttggcttgggaaattatggattctttcaagccactcccacaaggtgggtcctactagaaagggttagcattttaaggggggttgttctatacacctgtgtccttaccccaggctcaggaactgccagggagggaagatgaggtggggagtctgtactgagatggaactgtcagtgctgtgttgtatgtacttgctgttgtaaaagtttgggcatgactttgcatctagcgggtgctgcctgcatctctttgtctgtaagcttgctctgggactcagcctcttaggacctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccaccagtcccactcaatgctgctctaactctacccacacccacctaattaggggtgctaataaaacatgctgaggttgagataaagacgggacataaggggaaaattcattccatagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattatttaaatagtaaagaaaaaaaaaaaaaaaaaaaaaaaaaaaaa

SEQ ID NO: 484 - DNA, 4620 bp, Homo sapien
aacaactctgctcatggtgattacatgcaaaataacgagagcagcttaatagagcaagctccaatacctcaggacggacttaccgtggcacctcacagagctcagcgagaagctgtacacattgagaagataatgttgaaaggagtccagagaaaaagagctgacaaatactgggagtacactttcaaagtaaattggtctgatctttcagtcacaacagtaacaaaaacccaccaagaactacaggaatttctactgaagcttccaaaggaactgtcttcagagacttttgacaagaccatcttaagagccctgaatcagggttccttgaaaagggaggaacggcgacatcctgacctagagcccatcctaaggcagctattttcaagttcatcacaagcttttctacaaagtcagaaagtacacagcttctttcagtccatatcatcagactccctacacagtatcaataacttacaatcctctctgaagacttctaagatattagaacacttaaaagaagacagctctgaagcttcaagtcaagaagaagatgtgttgcagcatgccataatccacaagaagcatactgggaaaagtcccattgtgaacaatattggtacaagttgttctccattggatgggcttaccatgcaatattctgaacagaatggaattgtggattggaggaagcaaagctgtaccaccattcaacacccagagcactgtgtgacctcggctgaccagcattctgctgaaaaacggagtttatcttcaataaataagaagaaaggaaagccacaaacagaaaaggagaaaattaagaaaactgacaacagattgaatagtagaataaatggtattagactctccactcctcagcatgcccatggtggtactgtgaaagatgtgaatttggacattggctctggacatgacacatgtggagaaacatcttcggagagttacagttctccatctagtccccgacatgatggaagagaaagttttgaaagtgaagaagagaaagacagagacacagacagcaattctgaggattctgggaatccatcaacaactaggtttacaggttacggttctgtcaaccagactgtcactgtcaagccacctgttcaaattgcttcactaggaaatgagaatggaaaccttttagaagatcccttaaactcacccaagtatcagcatatttcttttatgccaacgttacactgtgtcatgcacaatggtgcccagaagtctgaagttgtcgttcctgcacccaaacccgctgatggcaaaaccatagggatgcttgttcctagtcctgttgctatttctgcaataagggagtctgcaaattcaacccctgttggaatactagggccaacagcttgcactggagaatcggaaaagcaccttgagttactggcttcccctttacctattccatcaaccttccttccacacagtagtactcccgctttgcatcttacagttcagaggctaaagttgccaccaccacagggatcttctgagagctgcacagttaacatcccacaacaaccacccggaagcctgagcatcgcatcaccaaacactgcctttattcctatccataacccaggtagtttcccaggctctcctgttgctaccacggaccccatcacaaaatctgcatcccaagtggtaggactcaatcaaatggtgcctcaaattgagggaaacacagggacagtccctcagcctaccaatgtgaaggtagttcttccagcagctggcctctcagctgctcagccaccagcttcctaccccttaccaggctctccccttgctgccggcgtgttacccagccagaactccagtgtgctcagcacagcagcaacttctccccagccagcgagcgcaggtatcagccaggcccaggcaactgttcctcctgcagttcctacccacaccccaggccctgccccgagcccaagccctgccttgacacacagtaccgcgcagagtgacagcacctcttacatcagtgctgtggggaacacgaacgctaatgggacagtagtgccaccgcagcagatgggctcaggtccttgtggttcttgtgggcgaaggtgcagctgtgggaccaatggaaaccttcagctaaatagttactattatcctaatccaatgcctggaccaatgtaccgagtcccttcattctttactctgccatccatttgcaatggcagctacctcaaccaagcacatcagagcaatggaaaccaacttcctttttttctgcctcagactccatatgcaaatggactggtacatgacccagtcatggggagccaagccaactatggcatgcagcagatggcaggatttgggagattctatcctgtatatccagcacctaacgtagttgccaacaccagtggttcggggcccaagaagaatgggaatgtctcatgttacaattgtggtgtaagcggacactatgcacaggactgtaagcagtcgtccatggaggccaatcaacaaggcacttacagactgagatacgcacctcccctccccccttctaatgatacgttggattctgcagactgaaacgagtaaagcttgcctacttaatacactcaagtgtggggagtcatggggtgtggaggggaggaaaggaaaggtattttgtttctttgtctatacatttcctagatttctatgcagttgggatttttcatttctcttgtaccaatgtccaaaacaagaaagaatgcaatgcttttgagcctctggtctcctggttcaacaacaggcttatatgtatgatacatgtaatttaaaccttcagacaaacttaaatgttggtgcgtgcttttttttttttttttacactgaatacttgctgtgtgcaatgtttactgaatctttaaaactgtgtatttgaccttttttttacaacactggtgacagtcatatggttttgaaaaaaaaaagaaattttgcttcttcccagcttttctcactttcaccctaaacgacacttcctccccagccagcctcactctgtctccggcccgcagcaggagcagccagcagtgcattcaccccacttttgtaaactgctctgcatataaaccaagggcagaatgtttcaccctgatcttatgggaggaatcaaactcccaaaatagtgtgtatatatgtaataaacagcgtcacgtaaatacatatatgcagtgcttgttgtccaaatagaaatgaaaataagtggaagagagaggaagaagtcaaaccatatgaaactgaaaaaatatgacgtacgaaatggacaaaaagctttttctgaaaccaactttttacttccatcatccttttttagcctgttgcttcagagagacacaaagtgaacacactggtgtgaatgtcgctctctgtgtgcttgtgtttgtaatgaaagtctacagccaattttacttgtctaccaccgtgttgtgctcaaagagacactacttgagtgaagatttcttctttccctgtaccagctgttacagtgttacgttgtgtttaaaatgtgtatggtttattgcaatctgaacagagctatgggtttctaccataagtcaggttgtttgttccctaacctgtctctcgtagcaaagtcacttttataacagtttaccactatgcttgattataatgtgaaaggcggaattctgagtgtgttaagatggtattaatcatgtcggtgtcatgtcactaagtttaatgctgctgtttttaaaaaaaaaaaaaagtttttttaaaaagccaatctatgtactaaattgcttccaggtaatttttgatttcctaaagtgcactgaggttatctggaagattgggtgtattttttggtgactgctgcattcatcagcaatgaacagtttccactgtatagtcctaggggtcagggggtgggggtttcattttccattcctcagcacagagcagaaatgatagatttttattgtttggagtaacgttggtatgcagcagaggaacgtaaacatttggtcttggttcagaagcctaacagattgctagacaagagaaaaaacttgaagaaaaaagaagcttaatttcatgcttcataagtagcatttatatttatagcaccaatgtacattttgaaactttctttcaggggtgggagttatggggaaggggtgggtgtgaaggggtagatgaaagctttaatttagaaagaaagttcaagtaaaggaaattattttgattaaatatattttatttgatctgggtatttttggaccacattattaaattaattgttaagctgcagttgagttgttcaagtgagagttttgataagccacttatgggccgcgttgtgaatcacttgccagttgtactttatggagcttattttatgatttaaaatactgtactgtacataggaggtatgttaccttctccttatttgtatgtttaccatatactttgatatttgaaatgttatgtactggaaaggccacttatatttctagaacagattggattttatgcaaccttttttccttgaattaacagcaataaaaaaatgaaaaacagcttaaaaaaaaaaaaaaaaaa

SEQ ID NO: 485 - DNA, 4457 bp, Homo sapien
ggcgcgaggcgctctcgctctcctcctcctccgccgtcgcccctccccccgcgcagcccccgccgccaccgccgcgagacccccgcacgccgctctccccccaccctctcctgccccgcgcgccctccggcccctgcggcccccgaagagaacgagagggcgagcgagcgcggcgttcccgggccggcccggccccctcccttcaccatcgccggccctccgccgccttcctccgcttccacctcctctccccccccccaagttgaggccccctccgggggggggaggcccgggaccgggacccgtagcgaattctcctaactccctcgacctctcctctcgcccggcccgagtgtgaggagaagggcccggcccggcctgcgtcgtgtgtgaggaggaccccgggcgggcccacgggccgtgtggggcctggtctggcccgccgggtgtgtgaagaccggggcccggtgctgcccggccggagggcgagcggaggggaggggcctggtccggcccggccggtgcgtgaggactggggcccgggcccggcgccgccgccgccgccgccgccgcgatggcccagcagcagatgaccagctcgcagaaggccctgatgctcgagctgaaatccctgcaggaggaaccggtggagggcttccggatcaccctggtggacgagtccgacctctacaactgggaggtggccatcttcggaccccccaacaccctctacgaaggcggctacttcaaggcgcatattaaatttcctattgactacccctattcaccacctaccttcagattcttgaccaaaatgtggcaccccaacatttatgagaatggagatgtatgcatttcgattcttcatccgcctgtagatgacccacagagtggagaactgccttctgaaaggtggaatcctactcagaatgtgaggactatcctattaagtgtaatctcactgcttaatgagcccaacaccttctccccagccaatgtcgatgcttcagttatgttcaggaaatggagagacagtaaaggaaaagacaaagaatatgctgaaattattaggaaacaagtttcagccactaaggccgaagcagaaaaggatggagtgaaggtccccacaaccctggcggaatactgcatcaaaactaaagtgccttccaatgacaacagctcagatttgctttacgacgacttgtatgatgacgacattgatgatgaagatgaggaggaggaagatgccgactgttatgatgatgatgattctgggaatgaggagtcgtgacgtgctccttcagtgcccctgtactgccctgccatctcaggccaaagggaggggagcaagtggggacctggccatggcccctcagcaaaaacctattcacagcgggtggggaaacacacacagctcctgctgactccccttatggatctcagtttgctcctttttatggacctttaatggagagagagtaaccctccacagaatgtctgaattcttgcattctttacccttccatcactatattgattctttttttaaaaaatatgaacccaaactcccgcctcacttcgtctctacagaatgttcacagcaaaacacgtttggtctgtttttagattcttgaagaattcaatagtctttcaagatgtttaatgtgtttaaagctgggaacctgttgggagttcacaagtgctgcatatactgggtagcaaaagaaaatggaaaaaaacccacaaaacaaactttaaaaaaaaaaaaaaacaaatttgccaaggtttagctgctcatttacattagtgtgtgtgcattcgttcagccccatggtggtgaattctgtttctttcctttcctaaggctgggacatggtgggcatcagggactttgtgctaagcctgatgaaatgtgctccttcaatctccatgaaaccatcgtaacatggaggcctcagctgctctgaggagagaaatcagactttgttttttgaaatcgattgggatcgaaagcctgaaataaatattcatactttccatagaactgagcacttggttgctatttattttaaaggcagggttatttccccccagggagtggggcaagcggggaagttgggatgagtgcgtgtgggagcaaagagttaaaaatcactatgctaagtttggttgatgctactggggggaaaaagttgaaactactggtgaccactgttgggagaggaaacatctgttttatagatttagcatggccttcccatcaaaaatacactcgtaccatgacgttttgtttttgttttttaagtagccacttttaattactcagtattaatcctaggtgcatgtgttaagatttcggttttcatcgagctgcttatactgatagtgaaaaacttggatgtgtgtgagacgagttaccgccttcttcattggatgtgatctgaactttttttctcctttcaacatacttaggctgtggagtgcaagcagaattatgcatagaaattgtggcagggctgagggagttgactgcaggcagtttttaggccagataaggctagatcttcctgcaatgcacttgctgcagctttgattttccagatctcaatcgtgttgcttcaatcaatattgagatccagcagccttcaccatccaggagacttcagaacttgaaggtaatttttggttgttatgggggtgcaccagatcataggagggcattatttggaggaaaccgctataatgtaaaatcagatttcagaaggaaaatgcagcaaggactgactgtagtcctatttcagacccctgggcactagtgtcaactcctcctttggctcgtaactcagaaagaaccaaagggcagattagggacggggcaggagggatcctaggatggccagagtaggtgacgcttacttccttagctcctccttccattctgatctcagggttttcactcttcaaactcccaaacacatgacttcttcccagcagcccttcccggcctctaaagtttggtcccagcagcccttcccagcctctaaagtttggtctggtatgaaatgggactgtttaacaagcaaggctcttaggggacactgttgagcctggtcccagaatctgtgatctccacagggccagggttgctacttgcacccagaatctagtgattttagtcagatccatggaacagagcagcttcgtaatacattgtcaagttacctgattacaaactctcatagatgttggaactacctttttactccccatactttgtaagtaatgcttccagattaacctgcaaatcttgtggagccaaagcctctcacagtgctgatttacctcccccaaaatgcccccaaacccccatgcaagtttacagccagtagcttggtcttattctcttggagccctaaaattaagcctttcattcccctttgctaaagcatctcactcccagggcagccccagcaccctggcattgcgggaggtgctctgctgcacagctgttccatcaggccctattggcctctgttagacattgactcagggagccggagcgccaagtggaggttgtacctttcagccctttggggtgttaaaagtgtcaagggctgggtttgcctctgatgagtacaatcagttccagaagactgggtaagtctcttgctagcaggtggacattctggtattttagactgactgaacgaaacccagaggctggttccagagctctgtccctgagaacacatccctgtggaaaatacttgagtttgtaattttttttcccccttctgggagtggaggtctcaggctcaatccggaaccatgtacgtacagttttgcttattatttgatgtgacatgaactcaaaatcctgcatttttagattccttttagttctaattgaggcctcactagatgctcttcagttctgtgtattttgaggctgggtggagaagtatatgattctgctgttgattctttcagtcttccccccttctccttttatcaatcattccagagttattttctattagtcaaacttttttgtagaaccttctttcccttaccctggcaaattgcttctttacttgctggtttccttacgtttggggcacatgttgtaagaaactgattggaaggggaaatgtgcagctctccactggaaaggaactctccacccctcccatcctgataaaacaaacaaggtttacatttacaactaaaaggattcagatgcaattttcaactattctgaaaccagcaggacacacctgactttaatagttttagctgaaattgtagatgttttgcttcagtttaacttatgagaaaagattatctgacggattttgtgttgacttcccctttagtggtttattttgtctttttctgcccatctgtctactaataaaatgtgaaataaaatacctgtattgctacttccccatgaa

SEQ ID NO: 486 - DNA, 1724 bp, Homo sapien
aaaaaaattttcttccgccgtccgccggtggcgaggcccaggctgtcgccgggtgtgcagcggcgtcgcggccagtagagggattctgggtaacggcccggacccccggctgggcttctggctcggcgcagcaggttccattcacgccaagtctgttggcagtggcagttgtagggccaagggcggttgtaggacccggagcagccggacatggaacaaccgtggccgcctccgggaccctggagcctccctcgggccgagggtgaggctgaggaagagagtgacttcgacgtgttccccagttctccccgctgcccgcagctgccaggcggcggcgcccagatgtatagccatggaattgaattggcttgccaaaagcagaaagagtttgtgaagagctctgtggcgtgcaaatggaatcttgctgaagctcaacagaaacttggtagcttagcactgcataattctgagtccttggatcaggagcatgccaaagcacaaacagcagtatcagaactgaggcaacgggaagaagagtggcgacagaaagaagaagctctagtacaaagagagaagatgtgtctgtggagcacggatgccattagcaaggatgtttttaataagagttttattaatcaagataaaagaaaagacacagaagatgaagataaatcagaatcatttatgcaaaaatatgagcaaaaaatcagacattttggtatgttgagtcgatgggatgatagccagagatttttgtctgaccatccataccttgtatgtgaagaaactgctaaatatcttattttatggtgttttcacctggaagctgagaagaaaggggctttaatggaacaaatagcacatcaagctgttgtaatgcagtttattatggaaatggccaaaaactgtaatgtggatccaagagggtgttttcgtttatttttccagaaagccaaagcagaggaagaaggttattttgaagcattcaaaaatgaacttgaagctttcaagtcaagagtaagactttattctcaatcacaaagttttcaacctatgacagttcagaatcatgttccccattctggtgttggatctataggtttattagaatccttaccacagaatccagattatcttcagtattctatcagtacagctctctgcagcttaaactcggtggtacataaagaagatgatgaacccaaaatgatggacactgtataatttggttaagactgctgaggccaagtgctattttgttacaagaaaggaagaacttggctattttcttgacacttttatgggtgctgcactttatttttgttcggtttttgatgggagggaaagagtactgaaatgttttgtaaattttttttaatgtgctgctaggttttttgttttgttttgttctgaagagaagagtggtaccatatgttgcaggaagtcaaactggactttttgtggctactaaatttgcttttaatcttattgttctcaattttggaatcaagtatgaaaatctgcacaaatgcaatgtttacaagaactggttgattctgggaggcatctgctacagtctctttttatatggatatgtacatgtcctattctacaaaaatgattaaagataaaaacatacttgtatcccactgctactttagctgtcaaatttggtgtttcatcacattaaaagcaataaatcagtaaaaaaaaaaaaaaaaaaa

SEQ ID NO: 487 - DNA, 2171 bp, Homo sapien
gcgggagagcgcagcgtcgaccctttgtggacgccgagtggcggtcgctcgccccgccccgcgccgtcgggcgctccttcctcagcggcgggaagctggcggcagcggcggtggcgctggctgagcagaggacccggcgggcggcctcgcgggtcaggacacaatgtttgcacgaggactgaagaggaaatgtgttggccacgaggaagacgtggagggagccctggccggcttgaagacagtgtcctcatacagcctgcagcggcagtcgctcctggacatgtctctggtgaagttgcagctttgccacatgcttgtggagcccaacctgtgccgctcagtcctcattgccaacacggtccggcagatccaagaggagatgacgcaggatgggacgtggcgcacagtggcaccccaggctgcagagcgggcgccgctcgaccgcttggtctccacggagatcctgtgccgtgcagcgtgggggcaagagggggcacatcctgctcctggcttgggggacggccacacacagggtccagtttctgacctttgcccagtcacctcagcacaggcaccaaggcacctgcagagcagcgcctgggagatggatggccctcgagaaaacagaggaagctttcacaagtcacttgatcagatatttgaaacgctggagactaaaaaccccagctgcatggaagagctgttctcagacgtggacagcccctactacgacctggacacagtactgacaggcatgatggggggtgccaggccgggcccctgcgaagggctcgagggcttggctccggccaccccaggccctagctccagctgcaagtccgacctgggcgagctggaccacgtggtggagatcctggtggagacctgagcaggagccctgagtgctcacagccgcctctgacgcattgacacgtgagcactggctcccacggagggtgcgcctgccgccagcggcccagccttgctgccctgtctgctgattctgagaaatcccagaacagcccattaccagtggggctgcagccctaggcccgtcccactcacctcccccctgtggagggccaggcagaggctgttctggaaggcttcttgtcttctgacgtccccacagccctgggcccctcgtgtctctttgtgtcccccactgtagaggacggtgagccgcagctgcatcaacctccttttacctttagataggtgaatttttacaattcagttttacatgttttgggcagtattttgtcttaagatatattttttaaactttttataccttatctctttagattttttcagctattttcttaaaagtatattttttctataaacatcctttgctgctacattagaacttttatagcctaaacaattgcagttggtgtgtttcatttttttaaggtttaaataagggttttttgttttgttttgttttttgcagtgagcatcactacagtctcagtcaacagtgtgaatgtatcatgttttactttaaatgtgtgtgtgatacttcttcattatgtcctgcgctgcagtgagacctgggtgaaaatcaggagccgcacacagccacatcttcctagacctaagagtaaattatggaggattttatttatgtctatttatatgtaaatgtcattgaagacaaaggtcaaatatttgtctgtttgtagatcacaggcaccagttggtcttcagggacctcatagcccctcggtggtgccttctcaaggcagtgttcctggaggctcccatcagggtcagcccatgcacctgccctgggtgaggaagtagcattgctgctggatgagaaacgcctgcgctgctctgttagactggtgctgaaacaaaaggttaaggctaggttgaagtctagaatgaaagaaatctgaatccatgtcattcataaccccttgatctgtagtgtcatgggtgctgccgcaggcagggagtgagctgggggtgcctgcagccttccactcctgccccgcctcaccccacatgctccctgtttctcatgctttctctaacttcctcaccccttaaccaaaaaggtgtgttttcttttgtgcatatagccattcttaaatatcagtgatgtaaacctcactttattaaaaaattatccagcaaacaaaaaaaaaaaaaaaaaa

SEQ ID NO: 488 - DNA, 3122 bp, Homo sapien
actcgaacgcgcgacggcggggggaagatggcggagtccggcggtagcagcggtggtgctggtggcggcggcgctttcggcgcgggcccgggccccgagcgcccgaacagcacggccgacaagaacggggccctcaagtgcaccttctcggcacccagccacagcaccagcctcctgcagggcctggccaccctccgcgctcagggccagctcctcgatgttgtgctgactattaacagagaggcctttcctgcacacaaggtcgtcctggctgcctgcagcgactacttcagggccatgttcaccggcggcatgcgggaggcaagccaggacgtcatcgagctgaagggcgtgtcggcccgtggcctgcggcacatcatcgacttcgcctacagcgccgaggtgacactggacctggactgcgtgcaggacgtgctgggcgcggccgtgttcttgcagatgctgcccgtggtggagctgtgcgaggagttcctgaaggcggccatgagcgtggagacctgcctcaacatcggccagatggccaccaccttcagcctggcctcgctgcgagagtcggtggatgccttcaccttccggcacttcctgcagatcgccgaggaggaggatttcctgcgcctgccactggagcgcctggtcttcttcctgcagagcaaccggctgcagagctgtgccgagatcgacctgttccgcgcggccgtccgctggctgcagcatgacccggcccggcggccgcgcgccagccacgtgctctgccacattcgcttcccgctcatgcagtcgtccgagctggtggacagcgtgcagacgctggacatcatggtggaggacgtgctgtgccgccagtatctgctggaggccttcaactaccaggtgctgcccttccggcagcacgagatgcagtctccgcgcaccgccgtgcgctcggatgtgccctcgctcgtcaccttcggcggcacgccctacaccgacagcgaccgctcggtcagcagcaaggtctaccagctgcctgagccgggagcccgccacttccgcgagctcacggagatggaggtaggctgcagccacacgtgcgtggccgtgctggacaattttgtgtacgtggccggggggcagcacctgcagtaccgcagcggcgagggcgcagtggacgcctgctaccgctacgacccccacctgaatcgctggctgcgcctgcaggccatgcaggaaagccgcatccagttccagctgaacgtgctgtgcggcatggtgtacgccacgggcggccgcaaccgagccggcagcctggcctccgtggagcggtactgcccccggcgcaatgagtggggctacgcctgctcgctgaagcgccgtacctggggccatgctggggccgcctcagggggccgcctctacatctcgggtggctacgggatctcagtggaggacaagaaggccctgcactgctacgaccccgtggccgaccagtgggagttcaaggcgcccatgagcgaaccccgcgtgctacacgccatggtgggtgccggcggccgcatctatgccctcgggggccgcatggaccacgtggaccgctgcttcgacgtgctggctgtggagtactatgtgccggagacggaccagtggaccagcgtgagccccatgcgggccggccagtcagaggccggctgctgcctgctggagaggaagatctacatcgtcgggggctacaactggcgtctcaacaacgtcacgggcatcgtacaggtgtacaacacggacaccgacgagtgggagcgggacctgcacttcccggagtccttcgcaggcatagcctgcgcccccgtcctgctgccccgggccgggaccaggaggtagcccccaagacccccgggaccctggcctgaccgcatgttgtctccaagtggggcttggcgaatgcacgtctgcctgagaaccccagtgccccccttcgcccgggctgcccttgaggggcctgctgcgttgataagcccccctcccaggggtccctccctccctccttcccaaagcagatcctggctgcgagtccatccgagggagcctgccggcaaagcgtctgacatgtggtggcagcaaattcgtccccggggtggtttcctcgcctggcccccgagtccccacgggctggcgggtggaatcccaggtctccagggggtccctgtgcagctccatctcacttctctactgcctcccagccccacggtttcaggcattcagatgtgagctcatcaacattgaacccaaagtcggtggtatatgactcaccctccttccaagtctcctgcgcgcgtgtttttaaaataaactcacccgaaacgtccgtaacacacggacctccaggagcagtgagaggtggcttagaagcccctggtttggggtgggtggaggaggagggcacgtgtctgcctcccctggggtgccctccttcccccatcccaagctgctgaggggaggccctggtcatgcctcagttcctgccttcatctgctttccggaggaaaaaccatatcaactcctagaaacgctccttaggggcttgggaccttccatttggcactgagcatcttgtggggccttaactggctgagacatcccggccctctacatttgccctgttggccaggcagtccccttcccgcaattggagggcgacgctaacttcagaatcccatagtggcgcttgccgcaggtctggtggggtgtcttttttctcctccctcctttccacccctccgcgccctgccactccctggcctgccctgtttttgggtcaacattgctacggagccagcagtgaggcctttcccttcaagggctctgtggtatctctggccacatttgttctaatgtctgaacctctaaatcttttctttttgattggttttactgtttttaagaagccagcactgctgtctcatagatgggatttgtactcttggggcaacttaaagtgtctctctcgctgctaacagacgattgatgtcttgtctctgtgacccactcaccatgtaaagaattaacctcctatcttagcagacatcgtctcctaatatttccctttatttaataaaaatgttatggtg

SEQ ID NO: 489 - DNA, 2712 bp, Homo sapien
gttcggctgaggaagggagcgcacgccggcggcgcggaggccggctctgcgcttcgggccgccccctccccccaccccgctcacacccggcacttacttcggctgtctccgctgccctccagcggagacgcagctcctcaggcgcccggcggtatttgttgggtcggcggcgtcagggattcgcagtggcctgtggtcggcgtcgtccggccactggtgcgcccccgcggcaggcagagctcacgctcctgtcccccggctggtccggggtctgggcgccgcgtcgacggcggctccgcaggacgcgcagaccgggccgcagcccatgccccgagcggactgcattatgaggcacctgccttacttctgccggggtcaagtggtgcggggcttcggccgcggctccaagcagctgggcatccccacagctaattttcctgagcaagtggtagataatcttccagctgatatatccactggtatttactatggttgggccagtgttggaagtggagatgtccataagatggtggtgagcataggatggaacccatattacaagaatacgaagaagtctatggaaacacatatcatgcataccttcaaagaggacttctatggggaaatcctcaatgtggccattgttggctacctgagaccagaaaagaactttgattctttagagtcacttatttcagcaattcaaggtgatattgaagaagctaagaaacgactagagttaccagaacatttgaaaatcaaagaagacaatttcttccaggtttctaaaagcaaaataatgaatggccactgatgaaaaattgtattatttattcattcactgttttctagtgtttctgtgtttattactgttcagcatcatcttggttatatactgaaaatcaaacactttactacagttgtgaattagtttaaaccgtacaatgttgttatcatatcatgcttcaactattaaattaagcccatcatatcatagcactaaaaagattgagttaaaaataagatttaaaaaatatatattgattaaaatgtaccactagaaaggtattacatgtgtataagtatgggtaaaaaggcaagtcactagtttgagatgaaaactaaaattttcatggtaaaatgccagcatgtatgtacttgtgtagtgtgtacttctaaacagagaaggcttataaaagtaaatgcattaaggccaagtgcagtggctcacaccggtaatcccagcactttgggaggccgaggtgggaggattgcttgagctcatgagttcaagaccagcctgggcaacatagcgagactccatctctataaataaaaaaaaaggaaatgcattaaatagaaggttgatagtttatcataaacctgcggggaagaaactcagactttctatttttgatattttgtgcattaatacattacaaacatgaagatgtttgtaaagttttgttttagtcattttctttgcagtcacatcattgtaccaccttcattattgtatagagctgcttcaattctgagtcctctggacttcccctgcctatctgtttgttgttgttgttgaagacagtaaaataagtgttttcaaatctatatgtctcctttttgttggataatgtttcttctttttaatggtaaatattcttgttcttcaacatttttctttggttcttttttccttttttaggaaaaacaaaacaacagacttcatccttaggttttctcaagatttaagtgaacacatttacacatatcaatttcttaaagaacacaaaatgtttcctccctagcaaaactatttaagagccaattaaactatgaaatagttataaaattatttttaatatttaaggccttgaaattatattccaaggcaaatctaaatgggtgtagttgtatatgcacgatgtaatttaatgctaaagagtacttacagcttgagggaaaagcataaagttttagttaaatagccttcatactgtggatttttcctcctactaactaatatgtgggaaattaagattacagatgctttgggccccctcaaacagtacattgctacagttcactgtagcaacagatttggtggtgatggggggatagaggtagaagcagatagaaggtaattttaaagttaatttattatgaatcattttcccctaatctgcataaatgaattagaactgattttaataaaaatattctgtgtaaaaagtactcagaaaaacatctaaagctgttggagaagagggactcatataaatagttggattgcgttttgctttttatttctttataaaaatatgtcaaaaacagtttttaattttagaaatcttatacttgaaagaaacctcaattatcagtggctttatgaagtaaagttaaaaacaaacataggaaatgtgaaaatatttgtgtttgttttgtctgactaacttgctgctaaatgctatctttaggtgtgtgaaagttctttgatatgttattgtccttttacatcttgttaaatagccattgcttttgagaatcagatagtgtgttgtttaggggttaattgtgtctatatctttcaaaaacttttatattatgtattataagaagttacagtagtaccattttgattagtctgaatgttttcaggccttgaaataaattttgactaagtaaaaaaaaaaaaaaaaaaaaaaaaaaaaa

SEQ ID NO: 490 - DNA, 1832 bp, Homo sapien
attgctctcctgccacggaggggagcgcttggtggcagtccgcgggcccggacggaaggctgaggcgacgcctcgacgacagcggaccggagctgcaggggcaacacattcagggcggggtgccccatttaggcctggctcaccggagtaagaaactacaacccccgaagtgccttgcgcctcaaggttacggaggcagtgaccacccaccctggagccatggtccacgccttcctcattcacaccttgagggccccgaatactgaggacacgggcctttgccgagtgctgtactcctgcgtcttcggtgctgagaagtcacctgatgacccacggccgcatggtgccgagagggacaggcttctccggaaggaacagattttagctgtggccaggcaggtagagtcaatgtgtcggctgcagcagcaggcatctggccggccccccatggacctgcagccgcaatcctcagatgagcaagtgccgctgcacgaggccccacgtggggctttccgcctggcagcagagaaccctttccaggagccacggacggtggtgtggctgggcgtgctctcgttaggctttgccctggtgctggatgcccatgagaacctgctactggctgagggcacgctccggctgctgacacgcctcctccttgaccacctccggctgctggcgcccagcaccagccttctgctgcgggctgaccgcattgagggcatcctcacccgcttcctgccacatggtcagctgcttttcctcaacgaccagtttgtccaaggcctggagaaggaattcagtgccgcttggccccgctgattcctcgttgggatggtgcttctgagggcaggcagagggtagacacacagccagatgaagcttggcatctccctcctacccagcagctctgatgtgctgctataccaggacaagtgggtgacacaagcctgcagaaagggggctgggcagagggtggaggaggtcctgcctgtcctcaggttagtggaaccacagaacttcctgagcctagagctgctgtgttacttagaccgctgccgtgcggcagccacgcttgtccttgaacccaccttcctccatccctgccagccgatagtgctagggtgaggagctgcctggagctcaccccgctcttcttccaaacccacagtcaaggccaggcgcggtggctcacgcctgtaatcccagcactttgcggggctgaggtggttggaccacctcaggtcgggagttcaagaccagcctggccaacatagtgaaaccccatctctactaaaaatacaaaaattagctgggtgtatggcgcccacctgtaatcctagctgctcagggggctgagtcatgggaatcacttgaacctgggaggcagagtttgcagtgagccgagagtgcgccacttcactccagcctgggcaacagagtgagactccatctcaaaaaaaaaaaaaaaatcccacagtcatcgaaacacaaaaggggtctcagactcccctgagggtggaggagctgtgcctgcatgctggcaggccacagcccctggctttgtgcccacttaggcagtattatcaacaaggtcctgctcagtgtccagcccccgctgagttcagaaatgcatctgccaatcagcagcaggattctgcagctccttttgtgccaagcccgttcccaccaggcaggctcgagataaagtcatcacagccttccctcatctgcagggagagaagttgctgtcagatgaatgtgagcagtctagcctggatgacatatttttcgttttgaattaaaagcactggctgtgtgattttaccctc

SEQ ID NO: 491 - DNA, 2509 bp, Homo sapien
tttttctggtagaaggcggggttctcctcgtacgctgcggagtctctgcggggtgtagaccggaatcctgctgacgggcagagtggatcagggagggagggtcgagacacggtggctgcaggtctgagacaaggctgctccgaggtagtagctctcttgcctggaggtggccattcattcctggagtgctgctgaggagcgagggcccatctggggtctctggaagtcggtgcccaggcctgaaggatagccccccttgcgcttccctgggctgcggccggccttctcagaacgaagggcgtccttccaccccgcggcgcaggtgaccgctgccatggcttttccccatcggccggacgcccctgagctgcctgacttctccatgctgaagaggctggctcgagaccagctcatctatctgctggagcagcttcctggaaaaaaggatttattcattgaggcagatctcatgagccctttggatcgaattgccaatgtctccatcctgaagcaacacgaagtagacaagctatacaaggtggagaacaagccagccctcagctccaatgaacaattgtgcttcttggtcagaccccgcatcaagaatatgcgatacattgccagtcttgtcaatgctgacaaattggctggccgaactcgcaaatacaaagtgatcttcagccctcaaaagttctatgcgtgtgagatggtgcttgaggaagagggaatctatggagatgtgagctgtgatgaatgggccttctctttgctgcctcttgatgtggatctgctgagcatggaactaccagaatttttcagggattactttctggaaggagatcagcgttggatcaacactgtagctcaggccttacaccttctcagcactctctatggaccctttccaaactgctatggaattggcaggtgcgccaagatggcatatgaattgtggaggaacctggaggaggaggaggatggcgaaaccaagggccgaaggccagagattggacatatctttctcttggacagagatgtggactttgtgacagcactttgctcccaagtggtttatgagggcctagtagatgacaccttccgcatcaagtgtgggagtgtcgactttggcccagaagtcacatcctctgacaagagcctgaaggtgctactcaatgccgaggacaaggtgtttaatgagattcggaacgagcacttctccaatgtctttggcttcttgagccagaaggcccggaacttgcaggcccagtatgatcgccggagaggcatggacattaagcagatgaagaatttcgtgtcccaggagctcaagggcctgaaacaggagcaccgcctgctgagtctccatattggggcctgtgaatccatcatgaagaagaaaaccaagcaggatttccaggagctaatcaagactgagcatgcactgctagaggggttcaacatccgggagagcaccagctacattgaggaacacatagaccggcaggtgtcgcctatagaaagcctgcgcctcatgtgccttttgtccatcactgagaatggtttgatccccaaggattaccgatctctgaaaacacagtatctgcagagctatggccctgagcacctgctaaccttctccaatctgcgaagagctgggctcctaacggagcaggcccccggggacaccctcacagccgtggagagtaaagtgagcaagctggtgaccgacaaggctgcaggaaagattactgatgccttcagttctctggccaagaggagcaattttcgtgccatcagcaaaaagctgaatttgatcccacgtgtggacggcgagtatgatctgaaagtgccccgagacatggcttacgtcttcagtggtgcttatgtgcccctgagctgccgaatcattgagcaggtgctagagcggcgaagctggcagggccttgatgaggtggtacggctgctcaactgcagtgactttgcattcacagatatgactaaggaagacaaggcttccagtgagtccctgcgcctcatcttggtggtgttcttgggtggttgtacattctctgagatctcagccctccggttcctgggcagagagaaaggctacaggttcattttcctgacgacagcagtcacaaacagcgctcgccttatggaggccatgagtgaggtgaaagcctgatgtttttcccggccagtgttgacatcttccctgaacacattcctcagtgagatgcaggcatctggcacccagctgctataaccaagtgtccaccaactacctgctaagagccgggagcatggaacgtgttgggatttagagaacattatctgagaaaagagttcacttcctgctcccaggatatttctcttttctgtttatgaagtacaacccatgctgctaagatgcgagcaggaagaggcatcctttgctaaatcctgtttgaatgtcattgtaaataaagcctctgctctcagatgtaaaaaaaaaaaaaaaaaaaaa

SEQ ID NO: 492 - DNA, 4786 bp, Homo sapien
ctcggcgctgaaattcaaatttgaacggctgcagaggccgagtccgtcactggaagccgagaggagaggacagctggttgtgggagagttcccccgcctcagactcctggttttttccaggagacacactgagctgagactcacttttctcttcctgaatttgaaccaccgtttccatcgtctcgtagtccgacgcctggggcgatggatccgtttacggagaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaagagaaatcttgtacaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacagatgacattcctgaaagctcactcttctcaccaatgccatcagaggaaaaggctgcttcccctcccagacctctgctttcaaatgcctcggcaactccagttggcagaaggggccgtctggccaatcttgctgcaactatttgctcctgggaagatgatgtaaatcactcatttgcaaaacaaaacagtgtacaagaacagcctggtaccgcttgtttatccaaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtgaaagctacttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccctcaaaaaacaccaaggtgtttcaaaaactcagtcacttccagtaacagaaaaggtgaccgaaaaccagataccagccaaaaattctagtacagaacctaaaggtttcactgaatgcgaaatgacgaaatctagccctttgaaaataacattgtttttagaagaggacaaatccttaaaagtaacatcagacccaaaggttgagcagaaaattgaagtgatacgtgaaattgagatgagtgtggatgatgatgatatcaatagttcgaaagtaattaatgacctcttcagtgatgtcctagaggaaggtgaactagatatggagaagagccaagaggagatggatcaagcattagcagaaagcagcgaagaacaggaagatgcactgaatatctcctcaatgtctttacttgcaccattggcacaaacagttggtgtggtaagtccagagagtttagtgtccacacctagactggaattgaaagacaccagcagaagtgatgaaagtccaaaaccaggaaaattccaaagaactcgtgtccctcgagctgaatctggtgatagccttggttctgaagatcgtgatcttctttacagcattgatgcatatagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaagacttcttctaattgcaactgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccagatgcagcaaattactattacttaattatactaaaagcaggagctgaaaatatggtagccacaccattagcaagtacttcaaactctcttaacggtgatgctctgacattcactactacatttactctgcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaatgtctaaggcctttacagaaacatttttagtaatgaggatgagaactttttcaaatagcaaatatatattggcttaaagcatgaggctgtcttcagaaaagtgatgtggacataggaggcaatgtgtgagacttgggggttcaatattttatatagaagagttaataagcacatggtttacatttactcagctactatatatgcagtgtggtgcacattttcacagaattctggcttcattaagatcattatttttgctgcgtagcttacagacttagcatattagttttttctactcctacaagtgtaaattgaaaaatctttatattaaaaaagtaaactgttatgaagctgctatgtactaataatactttgcttgccaaagtgtttgggttttgttgttgtttgtttgtttgtttgtttttggttcatgaacaacagtgtctagaaacccattttgaaagtggaaaattattaagtcacctatcacctttaaacgcctttttttaaaattataaaatattgtaaagcagggtctcaacttttaaatacactttgaacttcttctctgaattattaaagttctttatgacctcatttataaacactaaattctgtcacctcctgtcattttattttttattcattcaaatgtattttttcttgtgcatattataaaaatatattttatgagctcttactcaaataaatacctgtaaatgtctaaaggaaaaaaaaaaaaaaaaaa

SEQ ID NO: 493 - DNA, 5730 bp, Homo sapien
cctccgcctccactcgccctcgtgctcccttcagccccttcgcagctccgtgcgcaaggtcgtgtcccggaagtgaaggggccatgttgatgggtgacccggggagaggtacccggccagaggcgagtcctgcggagtggtagcgcgcacggcctgcggtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcagatgagcaatggcaggcgctggtgagcgcaaaggcaagaaggatgacaatggcattggcacggccattgactttgtgctctccaatgcccggctggtgctgggggtgggtggagcggccatgctgggcatcgccacgctggcagttaagcggatgtacgatcgggcgatcagtgcccctaccagccccacccgcctgagccattcggggaaaaggagctgggaagaacccaactggatgggctccccacgactgctgaacagggacatgaagacgggcctgagccggtccttgcagacccttcccacagactcctccaccttcgacacagatacattctgcccgccccggcccaagccagtggccaggaagggccaggtagacttgaagaagtcacgactccgcatgtccctgcaggagaaacttcttacttactaccggaaccgggcagccatccctgctggagagcaggctcgggccaagcaagctgctgtggacatatgtgccgagctccggagcttcctgcgggccaagttgcctgacatgccgcttcgggacatgtacttgagtggcagcctctacgatgacctgcaggtggtgacagctgaccacatccaactcattgtgccccttgtgctggagcagaacctgtggtcatgtattcctggtgaagacaccatcatgaatgtccctggcttcttcctggtgcgtcgtgagaatccagagtactttcctcgtgggagcagttactgggaccgctgtgtagtagggggctacctctctccaaagacagtcgcagatacatttgagaaggtagtggctggctccatcaattggccagccatagggtccctcttggactatgtgatccgcccggccccacccccagaagccctcacactggaggtgcagtatgagcgtgacaaacatctcttcattgacttcctgccatcagtgaccctcggtgacacagtcttggtggccaaaccacaccggctagcccagtatgacaacctgtggcggctgagcctgcgtcccgcggagacggcacgcctgcgggctctggaccaggctgactcgggctgccgatctctgtgcctcaagatcctcaaggccatatgcaagtccaccccggctctgggccacctcactgccagccagctaaccaatgtcatcctccacttggcccaggaggaggctgactggtctccggatatgctggccgaccgtttcctgcaggccttgaggggacttatcagctacttagaggctggagtcctgcccagtgccctaaaccccaaggtgaacttatttgcagagctcacccctgaagaaatagacgaattaggatacactctgtattgctcattgtctgagccagaggtgctgctgcagacgtagggcaggtgaaggccaaagcgggtgttggtggtcaggccctggattctccgttagatacacttggctacctagttggtgcctcacagggttcctgctgcctggtgtcttgctgatcatcaccctggtcacttcatgctgattagaatgacatctctttcgtctcctattttgttacccaactcttcctatttttgttaccaatcactgtgctctctgccgccccctggctccaggctaatttttctggaatgaattgagaaggtggcgtgctggcctgagctgatggaccacttggtgttttgcgttttggcccatgtttgctgcctctatctggtctgccttgcccgtttgcctgttcctattcagtgtcttttctattttttcctctctcgttcatgccttctgttttgctcttgtccctggagcatatctgcctaattaagatgttgccttttagttgaatgccactgaagagctgtgatagcatgtttcaaagctgaactctacagagcgagtgctgagacagtatttagggtttctgggagtgaggctggtagaagagttggcctttgaccacggttcctggagtagaagtccatcctccccccaacctcctgacccattcataaatgctgagaatgtctctcatgggaacactgttaatgacccacacaggataagctgaatgcaaagttatttgcaggttgaatttcttggtggctattagcagaagtgcagagtagggaaccagagctggttaagggcctagtgaagggtttgtgtgcccagtgtctgctcgtcatctgtggctgcaggggtcagacagacaaggatggggactgccagggcaccacttcatcatgaatgctggttttcacaccttttccttattttattgccaatcaggacaaggccttgaaggaacgcagccttagacatcaggtgaggatgatggaggtagacagtcgactgaatgtcagctggaaaatccagtcactagttggggtttggtggccatgttttctacccagacaggccctgcttttctaggatgtggccttagagcaagaacagacccaacagccagcccttcatcctccagcgtctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtcatcttggtttgtgtttttccctgtttgtagcaagactctgatgataattctgtttctcatctgcccattcagtattttgttttccttccgtcaagttgtcttattttttcaatgactacctctccatcattgaggttctggtgaagctctctgcagctgtctcattccttcccaacgatagtaacaggaaatgactctttagcatcgatacctcaacatcaatttagggtagagattcctgcccctcttttgtcacagattaggaaattgagaactagggttaaccttgactatatttagaggtctttttgcctcttttccccttaacaaggatttcttatggtggtttcagtttcatttgcataaaggtattgagagggaacaaaaaacataaagctgagaatcttgagagagctcatctaccctgtctgttggtcagactcaaatgagagttaaaaaaaaaaaaaaaaatctgtatgcctgagtaccatcctggatgaatctagaaggtatggggtagagcttgacagggttcctgtgtacccactgggtatccgttagaggtaagggagaggagaggattgatagagtgttgcaaaagtatagattattcattgagataaaggatttggtttccctgccatgagtattaaaaaaatttaagttttcccaagcttgcatctctgaccaaatttcacataaaacattggaaggaggctgggtgcggtggctcatgcttgtaatcccagcactgggaagctaaggcgggtggatcacttgaggtcaggagttcgagaccagcctggccaacatggtgaaaccccgtctccacgaaaaagataaaaataagctgggcgtggtggcaggcgcctataatcccagctactcgggaggctgaggcaggagaataacttaaacccgggaggcggaggttacagtgagctgagatcgtgccactgcactccagcctgggtgacagagtgagaccctatttcaaaaaaataaaaattggaagaagagcttaaaaaagataagattttaaagagtcccaagttatttaagttgagtgtaattgtcatttaaggaaggcaaatgagtttatcatccttcttaaagagcatctcttttaactgttggacaaaaccataactttgtcattttacaaggaagaacctcttaagaagtcctcagaaccagaagcaatgtgaactctcagcgctggtcctggtgggtttgctgaccatgactgggcaagccgttctttttgctgccatcttcctcatcataaagtgtggaacataggcaattgctttgagattcttggatagaagaggacaacattctgcacctgcccccttttttaaatctttggggaaagatgagtaactttccccactactctgccttcctgttcagtaactcttacttttgcctgaagtaacagcatcttctacttctccatctagagatttttgtgtgtgtgccatcaaggttagcaaactttatacgtagcctaacacttaaaaaatgcactcattatcttaaacctaataaattccagagtttattttggttctcctctgttgcccttcctaaaaaatgagctgaagatgacagtatttttctttacatgcttggttatgacttttaaagttttatttaaataaatgttgaagctcaagtttaaagaagcgttgcagaggcccacggtctcctgggtcccggccacctgtccatattccacatttgctgactgtgctccctgcactccactcaagttgagagttcaaatagtcttgaaggggaatcagcttcaggatggaaggacccaggagaggccccgaggtgggagggttctgtaaatacagactactgcgagtgtccagagctctctgccatgatacttccttgggactgacttggctgagaacgtgttctgtcagaggatttgttagaactctgcccttttgtctgaaactcaaggccaaggagaatgataggagacttaggacagagctgacccttgcaccaggctgggaggctgcagcccttttagatgccacttactgtaagtggccagaataccagagaggtgggttccatggtcaaatgcacagtaggtgtttacctttacatttggatcaccttgtagtctttaaattcttggtccctgaggccaagtccacaacttgccttctagtcacttgcctgcccgcagtggtggtggatgtgttagctggtagatttggaatcagtcaccagtctttctgtactgtcttggttagctctatataagtaggggcagcttagccctgaggcccagagacctgctgtcctttttctccttgagggaggaaataaaactgcggaatacaatgtccttccatagcatgggaagaagaaaataaacatctcctttccaacaaaaaaaaaaaaaaaaaaaaaaaaaaaaaaaa

SEQ ID NO: 494 - DNA, 2448 bp, Homo sapien
aaaagaaagggtgagcgcggctggaagcgcgcatgcgctgtggctaatgccgtaggctccttcagggctgagccatcccgcgtgtcttgcgctcggtggaaatgcccagccgagggacgcgaccagaggacagctctgtgctgatccccaccgacaattcgaccccacacaaggaggatctaagcagcaagattaaagaacaaaaaattgtggtggatgaactttctaaccttaagaagaataggaaagtatataggcaacaacagaacagcaatatattctttcttgcagaccgaacagaaatgctgtctgagagcaagaatatattggatgaactgaaaaaagaataccaagaaatagaaaacttagacaagaccaaaatcaagaaatagtcaacctgatttcacataacaatgtgtggcatttgttgttctgtaaacttttctgctgagcatttcagtcaagatttaaaagaggacttactatataatcttaaacagcggggacccaatagtagtaaacaattgttaaagtctgatgttaactaccagtgtttattttctgctcacgtcctacacttgaggggtgttttgactacccagcctgtggaagatgaaagaggcaatgtgtttctatggaatggagaaatttttagtggaataaaggttgaagctgaagagaatgacactcaaattttgtttaattatctttcctcctgtaagaatgaatctgagattttgtcactcttctcagaagtacaaggtccctggtcatttatatattatcaagcatctagtcattatttatggtttggtagggatttttttggtcgccgtagcttgctttggcattttagtaatttgggcaagagtttctgcctctcttcagttggcacccaaacatctggattggcaaatcagtggcaagaagttccagcatctggacttttcagaattgatcttaagtctactgtcatttccagatgcattattttacaactgtatccttggaaatatatttctagggagaatattattgaagaaaatgttaatagcctgagtcaaatttcagcagacttaccagcatttgtatcagtggtagcaaatgaagccaaactgtatcttgaaaaacctgttgttcctttaaatatgatgttgccacaagctgcattggagactcattgcagtaatatttccaatgtgccacctacaagagagatacttcaagtctttcttactgatgtacacatgaaggaagtaattcagcagttcattgatgtcctgagtgtagcagtcaagaaacgtgtcttgtgtttacctagggatgaaaacctgacagcaaatgaagttttgaaaacgtgtgataggaaagcaaatgttgcaatcctgttttctgggggcattgattccatggttattgcaacccttgctgaccgtcatattcctttagatgaaccaattgatcttcttaatgtagctttcatagctgaagaaaagaccatgccaactacctttaacagagaagggaataaacagaaaaataaatgtgaaataccttcagaagaattctctaaagatgttgctgctgctgctgctgacagtcctaataaacatgtcagtgtaccagatcgaatcacaggaagggcgggactaaaggaactacaagctgttagcccttcccgaatttggaattttgttgaaattaatgtttctatggaagaactgcagaaattaagaagaactcgaatatgtcacttaattcggccattggatacagttttggatgatagcattggctgtgcagtctggtttgcttctagaggaattggttggttagtggcccaggaaggagtgaaatcctatcagagcaatgcaaaggtagttctcactggaattggtgcagatgagcaacttgcaggttattctcgtcatcgtgtccgctttcagtcgcatgggctggaaggattgaataaggaaataatgatggaactgggtcgaatttcttctagaaatcttggtcgtgatgacagagttattggtgatcatggaaaagaagcaagatttcctttcctggatgaaaatgttgtctcctttctaaattctctgccgatttgggaaaaagcaaacttgactttaccccgaggaattggtgaaaaattacttttacgccttgcagctgtggaacttggtcttacagcctctgctcttctgcccaaacgggccatgcagtttggatcaagaattgcaaaaatggaaaaaattaatgaaaaggcatctgataaatgtggacggctccaaatcatgtccttagaaaatctttctattgaaaaggagactaaattgtaatgtgattcacaatgtaacaatataaaaataagtttttatataattatataaaagtaaggtactctgctgctttactattgtataatatagtagttttaaagtt

SEQ ID NO: 495 - DNA, 3425 bp, Homo sapien
gcgagctgtcaggccgagtgtcaggccgggcaggtacgcggcgcgcgcccccggcgccccccgctccccgccgggacgccccgcgccgagccggaggccgcgtggacccgaaagccgctgggaaaagtttacccaaggtccagcctagcccctaggcaccatgtcggacagtgatctaggtgaggacgaaggcctcctctccctggcgggcaaaaggaagcgcagggggaacctgcccaaggagtcggtgaagatcctccgggactggctgtacttgcaccgctacaacgcctacccctcagagcaggagaagctgagcctttctggacagaccaacctgtcagtgctgcaaatatgtaactggttcatcaatgcccggcggcggcttctcccagacatgcttcggaaggatggcaaagaccctaatcagtttaccatttcccgccgcgggggtaaggcctcagatgtggccctcccccgtggcagcagcccctcagtgctggctgtgtctgtcccagcccccaccaatgtgctctccctgtctgtgtgctccatgccgcttcactcaggccagggggaaaagccagcagcccctttcccacgtggggagctggagtctcccaagcccctggtgacccctggtagcacacttactctgctgaccagggctgaggctggaagccccacaggtggactcttcaacacgccaccacccacacccccagagcaggacaaagaggacttcagcagcttccagctgctggtggaggtggcgctacagagggctgctgagatggagcttcagaagcagcaggacccatcactcccattactgcacactcccatccctttagtctctgaaaatccccagtaggcatctgccaagaagggtgctgaaggctccagccagctgtcctgggtttccgttttggttccctttcatacagagggttttctatggatcactgccaaacattgggatcatctcctctgtccagaggtcttcaacaggaagatgccagctggcaccactgcactgtgatgggggccctctcctctgctgactctgccgtttctccaggcctccgctcagtgatgagaccaagagatcggagacaagcatggtgctgctgcttctgctgcttctccagaaaatccctgggacacctttgttccagcctggtttcctgggctgggctcaggaaagctgccaaattcagtcctatgttgggtccaagctgcccctgtgctgtttctgtcaagccaggtgtggacattccaagttcatatgcgtgaacaaaagaaaagaggaacccagtggatgtaacagaaccgactccagttgaatgtttagatttttgctaaactgttttctttttcccttttttgctgtggtttgcattcacggcagtagttagcccaggtgtggggaacgagagtgcactgcatgatagcgttctggtgagctgggaaggacccaccactgccactgaggattgttttggaagaaaggaatatttttatcttggggaccagctaagtctctgcagtagtgtgaaattccaaatggttgttttatcattggtttggtttaccaaaaaaaaggcagggaaaaaaaaaaaaaacaaccgtatgagcgcattggcttgtctgccgcaggcacagaagggtagaaagccacagcagggggcagtccagcagactctgactcaactttctaggcacctagcagagaaagataagatcaaaaggtgtttggtttttcttttaatttttattgtagtttttttgggtgggtgggggaagtaaactagactgaagcgatggattttttttttcttttttttctttagtgtttttccctttgttcttgaacacttttgccctgcagcctcagttttgaattcttttagcaacttggattagaggggcccatatgtcagaagctcccagcacctcctacttgggagaaaagtgagccatctgctggtcaggaagtcctccagagaggcagcttttcccacaatggtggcaggaaactttggggaaagcaggaatggtgtccactgctgcggaggaactgccttcagagaaggtggggctggaaaagggttagaagcctcctagctgggattgtctttgtttcacctttctttaaattagaattacagaagcccctgcccagtgaacagataacaattggtcttatgctcctccctttcccccattttttcttttgctgttttgttttttgttttttgtttgtttgtttgtttttttgagacagagtcatgctctgtcacccgggctggagtgcagtggtgcgatctcagctcactgtaacctccgcctcccgggttcaagcaattatttgcctcagcctcccgagtagctgggattataggcacccgccaccatgtctggcttttagtagagacggggtttcaccatcttggccaggctggtcttggaactcctgacctcgtgagccaccacgcccagcctcttttgctgtttcattgctgacagtgttcaacaatatgccccatctttatatatcctaagaaacactaatcctaggttattgctagccaaaatatttttgtcctgagtagtgtcactgggccaaaagatagatcaggacgacagcctttagttttcctgaaatcaccaggtcaggcacaaggagaaaaggttcctggatactgactaacttgggtgggtctagccaggagaaagacagtaacatgtgttctgtactttctgggaagatccctgaagccatcacagaggctccccaacttctgagtcgcccatctgttgctgtgggagtgtgaacggatcgctgaaggagagggagctttgctctctctaggtgggcaagtttcctgggctctctgtgttgcctccctctggcttcttcctcccgtgccctctccccgtgtgccccagggggatcagggatcctcaccctcctgaggcccagtggggaagaatgaacatggcttcatccaggttaactgatgctgccatttgcccagcctcttccatcccagccctgtcagtgagcccaggtctggtgcaactgctgcaggatgcctgtagtagggaactctggaagtgtattgggctgaggtgggattttccctccccacagtgcactgagcaatggagggtggtgagggagccatgctgctgaattctggttggcatttccccattatgtaaaatggggtgttgggtagggcagactctgcttgggtttggttgtaagataaacctggaggagaagcacagttgtcccattgaattatttgagcaaaaactactgtaaataacttttttgtcttttgtcaaataaaatttttttttgtttttttaagcagaaaaaaaaaaaaaaaaaaaaaaaaaaaaaaaaaaaaaaa

SEQ ID NO: 496 - DNA, 1620 bp, Homo sapien
cggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaaaaaaaaaaaaaaa

SEQ ID NO: 497 - DNA, 2194 bp, Homo sapien
gcctaacctcttcctgcgatgagctcggcacgggaattattattgtcaattttacttgcaagaagtttcctacaagagccaaggaatccatgcgagtaaacatttacgggcaccatagataaaagcaatcctatgaggttgatactactatcctcatagaaggggaaactgatgccaggagaggttcaagcgtcttacctgaagtcacaaagcaaactgagtgatgaaggaagacttgaacctagaaaatttcactgcaaagacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccccttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggtttctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctcccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaaaaaaaaaaaaaaaaa

SEQ ID NO: 498 - DNA, 3866 bp, Homo sapien
gagttctgctccggcgcccccgagcaccgcccgcttcagccgaccagccccgtcggctactgggcctcgccgagacgagaggagggaaaggcctcggcggccgcgaggaggcggcgggggcgcgggcggaggcggcgcgggcggccgcggctgccgctttgttgtgcggcccgggccgaggaaggagaagtgggaggaggggggagctcggcgtcccgctccctccgcggctcatggcgacgactctcggcacatccgggaccctccggccgtggcggccgaggcgccggctgctcgggccccagccccggccgctgtggtgactccgccgcgcctcgccgtcgcccccgtgccgcccgccgcccccgccgcccccgccgccggggacatgtctaaccccggaggccggaggaacgggcccgtcaagctgcgcctgacagtactctgtgcaaaaaacctggtgaaaaaggattttttccgacttcctgatccatttgctaaggtggtggttgatggatctgggcaatgccattctacagatactgtgaagaatacgcttgatccaaagtggaatcagcattatgacctgtatattggaaagtctgattcagttacgatcagtgtatggaatcacaagaagatccataagaaacaaggtgctggatttctcggttgtgttcgtcttctttccaatgccatcaaccgcctcaaagacactggttatcagaggttggatttatgcaaactcgggccaaatgacaatgatacagttagaggacagatagtagtaagtcttcagtccagagaccgaataggcacaggaggacaagttgtggactgcagtcgtttatttgataacgatttaccagacggctgggaagaaaggagaaccgcctctggaagaatccagtatctaaaccatataacaagaactacgcaatgggagcgcccaacacgaccggcatccgaatattctagccctggcagacctcttagctgctttgttgatgagaacactccaattagtggaacaaatggtgcaacatgtggacagtcttcagatcccaggctggcagagaggagagtcaggtcacaacgacatagaaattacatgagcagaacacatttacatactcctccagacctaccagaaggctatgaacagaggacaacgcaacaaggccaggtgtatttcttacatacacagactggtgtgagcacatggcatgatccaagagtgcccagggatcttagcaacatcaattgtgaagagcttggtccattgcctcctggatgggagatccgtaatacggcaacaggcagagtttatttcgttgaccataacaacagaacaacacaatttacagatcctcggctgtctgctaacttgcatttagttttaaatcggcagaaccaattgaaagaccaacagcaacagcaagtggtatcgttatgtcctgatgacacagaatgcctgacagtcccaaggtacaagcgagacctggttcagaaactaaaaattttgcggcaagaactttcccaacaacagcctcaggcaggtcattgccgcattgaggtttccagggaagagatttttgaggaatcatatcgacaggtcatgaaaatgagaccaaaagatctctggaagcgattaatgataaaatttcgtggagaagaaggccttgactatggaggcgttgccagggaatggttgtatctcttgtcacatgaaatgttgaatccatactatggcctcttccagtattcaagagatgatatttatacattgcagatcaatcctgattctgcagttaatccggaacatttatcctatttccactttgttggacgaataatgggaatggctgtgtttcatggacattatattgatggtggtttcacattgcctttttataagcaattgcttgggaagtcaattaccttggatgacatggagttagtagatccggatcttcacaacagtttagtgtggatacttgagaatgatattacaggtgttttggaccataccttctgtgttgaacataatgcatatggtgaaattattcagcatgaacttaaaccaaatggcaaaagtatccctgttaatgaagaaaataaaaaagaatatgtcaggctctatgtgaactggagatttttacgaggcattgaggctcaattcttggctctgcagaaaggatttaatgaagtaattccacaacatctgctgaagacatttgatgagaaggagttagagctcattatttgtggacttggaaagatagatgttaatgactggaaggtaaacacccggttaaaacactgtacaccagacagcaacattgtcaaatggttctggaaagctgtggagttttttgatgaagagcgacgagcaagattgcttcagtttgtgacaggatcctctcgagtgcctctgcagggcttcaaagcattgcaaggtgctgcaggcccgagactctttaccatacaccagattgatgcctgcactaacaacctgccgaaagcccacacttgcttcaatcgaatagacattccaccctatgaaagctatgaaaagctatatgaaaagctgctaacagccattgaagaaacatgtggatttgctgtggaatgacaagcttcaaggatttacccaggactctatttatacaaccctgactgacagcctcctttcagcagagtttcaaagaatatgctgaaatacaggaaaacactccccccccccccctttttttttttttttttacattttaggacactgtgaggggaaaggacaattttgaaattccttttcaaggaaaaaaaaggtctttatgctttgccatgaggccacattcagctgctatttaaacttaatatcttgaacctaaagaatgctgacttttcctacatttccagagttaggcagtattctacacttaaagactactactatttttataaaaggtaatctattcaaatttcttcacagatttcaagtctctcaaacatcaagacaacttcagcagtcggtacaagtcacatttcattttgattgaatacatgatcttgaacagctcctgtacttgctctttgtaaaaaaaaataaaattattttgaattattctacctttgtaaacaattggctaaaagaatcatctttaagaaattaagccatttacatgtttgtgtttttctatagcagagcattatattttgcattatatgtttcaacctagtctaagtgggtcttttttacatttttcaagaacggatttcctggaatacagcgatataattttggttgtcaaattcctaatgcaaccatttagtctaaacttagtcatttatttgtgacaataagatgtgttcaggggctccctgtttttaagagactcttttaaaaaaaaaaaaacctaatgtttttatcttgagtcaatatgattaggtattttggatttacttttaatcttaaaatactgcatttttatagcttctcagagcatgtggatgggatgggattttcgttattttgctgggtcagcttatctttaatatatggactattcctataaaccaaagtctctgacaagtgcacctaatttatattgtattttaactacagtgtaagtttccattaacaaaaccatcctaaagcgttaactgctcataattttaatcagctacagttatgaaaaaggaagaattttgctctaaagattattaataagcttagaaaatcctgcttttacctaacagaatgaagtggggttgaggggcggtagtatgaacagtgattctaactctatggcgtaaattactttgaagagttcattttggaagtaagggaatcccgcttcccttgg

SEQ ID NO: 499 - DNA, 4401 bp, Homo sapien
tctaccagtacctaagatggccgccggcccatccaccgtcgcgatcggtgtgaggaaagtgtcacgaacccggaattgcccgactccgtcatggcaggcgccgggggcgtggcttccggcggccacagcttgctagtcgccgcggcggggtcgagcgggggcggcagctgacaggcgctcctcccccgaccgcagcggctggttcccagcgaggcgggcggcccccagctcgcgtccccgagtcctagcccgcgaggcgccagggctgcgcctgggcatggaagaggggaagatggacgagaatgaatgggggtaccacggagagggcaataagagcctggtggtggcccacgcgcagcgctgcgtcgtgctgcggtttctgaagtttcctccaaataggaagaagacctcggaagagatatttcaacacctgcagaacatagtggactttgggaaaaatgtcatgaaggagtttttgggggagaactatgttcattatggggaggtcgttcagctacctttagagtttgtgaaacagctttgtttaaagatacaatctgaaagaccagagtctcgctgtgacaaggacctggatactctcagtggttacgctatgtgccttcctaatttaaccagactccaaacctaccgctttgcagagcaccggccgattctgtgtgtagagattaagccaaaatgtgggtttattcctttctcgagtgatgtcacgcatgagatgaagcataaggtctgtcgatactgcatgcaccagcacctcaaggtagcaactgggaagtggaagcagatcagcaaatactgtccccttgatctctactcaggaaacaaacagagaatgcactttgccttgaagagtttgctgcaggaggcacagaacaacttgaagatatttaagaatggtgagctgatttacggctgcaaagatgcccggagccccgtggctgactggagcgagcttgcacaccacctgaagccgttcttcttcccttccaacggcctggccagtgggccccactgcacaagggctgtgatcagggagctggtgcacgtgatcacacgggtgctgctgagtggctcggacaagggccgggcaggcaccctgagtccggggctcgggcctcagggcccgcgagtctgcgaagccagccctttcagtaggagccttcgctgccaaggaaaaaacaccccagagcgctcggggttaccgaagggctgtcttctgtacaaaaccctccaggtgcagatgttggacctgctggacatcgaaggcctctaccctctgtacaaccgggttgagcgatacctggaagagtttcccgaggagagaaaaaccttacaaatagatgggccttatgatgaagcattttaccagaagctgcttgacctttccactgaggatgacgggacagtggccttcgcgctaacgaaggtgcagcagtaccgcgtcgccatgactgccaaggactgctccatcatgattgcactgtctccctgtctgcaggatgccagctctgatcaaaggcctgtcgtcccttcatcgaggtccaggtttgccttttccgtgtctgtgctggaccttgacctcaagccctacgagagcattccccatcagtataaactggacggcaagatcgtcaactattattcaaagactgtacgtgccaaagacaacgccgtgatgtcgactcggttcaaggaaagcgaagattgcacattagttctccacaaggtctaactctttccctgcagtgtctttgaaacttgaacataatgtgaaggctgaatgatagagatattttctgttgtgttgggtgacctttggttgtgaatgtttttgcttttaaccccttttgaggtgggattgcctcttggagacatggaattgaagagcactagaaacaacttcctggacaaggaatgtaggaagtgagtgctgtgtcccaggaagctgctcacactcttaaaatggaagtgtccgttaagccctgggaagacgttctggatagttcttctttcccaaccagggctcatgtctgattctctaatgcgaaaagccttattctaagacccaaggtttggatctgctaccaccagactcctaacatagaaaacttgaattgtcacatacattttacagtttggacttttaagaaaacatggatactactggaacttcccccagctgagttacatggtcactttttcagtgcaagccacatatcaacacaggtttttaggtggttccctgctgcacagcgtgacctcgtggtcgcgcagatgccgattctgagcagtgtagactcagggtccctgtggaggtgctgaagcccacagttccacacagggcagcagggagcgcaaggctcaggtcaggatggacaccactcatgcgagcattgacctttttttttttgctttacaatttaatctttcacatgagggggagatgagctgttctttcccactaaaaattgctgctgtagaagttggaggtggagctgtgactggctgagctgctgtggccgggctgggcagtgtgccccaacagctcagtgctttcctgacactccagtgtctggggtggttgaggagcgagttctctcttcctcccagaccaagttcctccctcgggtttgccttgagacgtgttgcgtttttgggccccgtggcctctccctgttaggctgccacaggccctgcttctggaaggtgaacagctcctggctgctgccgagagggttctcgttggggtcaccaaagtgtgcccggctgctatgaaaaacgttgggaatcttggtttcagttttttattctatgctaggttgtacagacttatttatatcatcgttttgagggactaatggaggcttattgtaacatataatattagtgaaaccatggaattatatgaaaatgatacatgagaaataaggaaactattttgctgattgtaaatttttgtgggaaattttgtgataacttgagaattatacttgtttgaatcaaggcaactcttctagaatttattgttcaattctgtcatatttacttctaattctactctcagaggtgcaaaaagatacttatctaactggacacttttactgttttcttctcacttccaatgacaccgtctcatacacacgggtcctgtgtgctgggatgggggctttggtgaagtgcacggagctcacggacaagccgcaggctctgggaagcgtggaggtagtggccgttgagtactgtcttgacccaagggagttcactgttgctgggctggggctggggcagcctggtttgggatgattttgcccattgtcacggtgtgtggaggatgctgggtcctgggttcaagtgcacatgtgagggaaccccagtccgtgggaaggtgggctgggctccctaggtccttcagggctgcaagagttattgcctagcacagggcccagacagggctggactagacacgatgaaaacagcctgtatttgagggagaagagaaaacagatggagacccccactctgtctggtcttggctcccaccagcccgggctgtgaggagcccctgagccgcgggtgccactgctgtggatgcgtttctggcccgtcttggaaactgctgctgctgcgtagtcatgacggccctgactggtttgagacaacacgcgttcacagatcttaacaatgctaaatgggcgactgatgaggtcacggttcttaaggcacatccgggacgatcgatatagcacttaggctatgcaggggggtctttctttcataaaggacctcattccttgcgtcccagcccaggaacagtgctgtctttgctgtcttaggccattcttgttattaagctgacagcttcactttcttgtggaagaccaagaacagcatgaggacttgctgagactgcctcacggtgccaccatgcggaccggggggaggcagggagtgagggtgtggctcccctgggctactaaggacagtttaaagatgaggcgccataggcatccgtctccagagcccccaggaggcaggaaccaggataagggtggcttctcccagctgagtaatgtggccaccatgtccaaggtggactcggtgtgaggctgcagtgggtgggggatggatcctccccacacatctgaggacacacaaccacttggtacattttctcagatgttaagcttatttttataaaccgcattgtacgtgtcacttttatttggcattttatacttaactagctgtatttatttttcatgtcatgagagtttccatataatgtgccataactgcatagacagcacgtcttcagggtgtggtttctaagcagaaaatagcaaatgtttatattgaataaaattgcatgttcctccacgc

SEQ ID NO: 500 - DNA, 3816 bp, Homo sapien
ggggtcgcgccgagccgagccgagccgagcggagccggcggagcctctggaatcacccgggtcgctgttcctgaggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccgtattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgccgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgttgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgtagcaccccggcctggagctcctgagaccaccgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtatagacaaggctgagcagggttcctgtggcccaggatggaggccaccgctgccctgccatcccgtctgcctgccatgggacggctcctctgagtgttccctggccccatgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggtccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtacgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgaccagaaaaaaaaaaaaaaaaaaaaaaaaaaaaaaaaaaaaaaaaaaaaaaaaaaaaaaaaaaaaaaaaaagaaaaaaaaaaaaaaaaaaagaaaaaaaaaaaaaaaaagaaaaaaaaaaaaaaaaaacct

SEQ ID NO: 501 - DNA, 2097 bp, Homo sapien
ggcgcgggtttggtggcgcgtttcagcgaagtcgcacgtgaaggatagcagtggcctgagaaagacccagtcatggcagcctccagcatcagttcaccatggggaaagcatgtgttcaaagccattctgatggtcctagtggcccttatcctcctccactcagcattggcccagtcccgtcgagactttgcaccaccaggccaacagaagagagaagccccagttgatgtcttgacccagataggtcgatctgtgcgagggacactggatgcctggattgggccagagaccatgcacctggtgtcagagtcttcgtcccaagtgttgtgggccatctcatcagccatttctgtggccttctttgctctgtctgggatcgccgcacagctgctgaatgccttgggactagctggtgattacctcgcccagggcctgaagctcagccctggccaggtccagaccttcctgctgtggggagcaggggccctggtcgtctactggctgctgtctctgctcctcggcttggtcttggccttgctggggcggatcctgtggggcctgaagcttgtcatcttcctggccggcttcgtggccctgatgaggtcggtgcctgacccttccacccgggccctgctactcctggccttgctgatcctctacgccctgctgagccggctcactggctcccgagcctctggggcccaactcgaggccaaggtgcgagggctggaacgccaggtggaggagctgcgctggcgccagaggcgagcggccaagggggcccgcagtgtggaggaggagtgagccggatgccccacacaccgccagtgtcataccaaagagctgagctgcttcggggccatgcagccctcctgccagccccctgcccttttcttgccctgtctctgaaccttcagaacattgatccttgccgcagccccactagccaagagaaacagagaaagaccattccccctgcctgtccttgcggccctgtcttctgaggttctctgtctggggttggctctcttaaccctttctctgctcccagcctgcctcaccagggaaggttggaggggcctccctctggcttctgcatctgcgccagcaaacatcactgccgttggtctctcatgacttaactggcttccctctgctgctgccttggcttcctcctaatgctcgtgctctcctgtccttctgaagttgctccttggccaaatctccagctcccttcttgttttcctcatcctcctaccctgtactcccaccaaaccatggtcctttaaggcacgctcctgtcctcctcattgcccagcagtagggaggggcaggggtaaggggacctgaggataaagggtggggaaacagggtcccctgaggcctgtgggggctgcaggggaggaggatgtaccttgtgtctctttcaagtgccttaatccgagccagcagggccttctgcttgcctgctgccatactgtatgtaggaaagtgttctgtggctgctttgtgtcaaaagagcagtcactctcagaatcttgattccccatcagccaaagcaaaagatggctgctgctttgtaggcatgtgcctgcaagtgggaccttgctgggcattatatgccctgtgggggtttcagagaccctgaaagaggagggaggacccgcctccttgtctgcacaactgcatgcacttctctccccatcgctccacaacctgaaaccgagaaggagttgctgaccagtgcccaccccggcagcccgggaggaacacaggcagctcctttcccttcacgtggtctgcagagagcagggtgagctgccagctgcccctctccaccagggtaccctgtcttggtggttaggggccacttttcctttgaggctctagtggaggtggatgtccttctctgccaggcttggcacatgatgtgaagaataaatgcccaattcttactgttcaggtttgatgtggaatcacagctgcagtgatatatattttttatcagtgcttggttggttttaaataaagtgcacgctattttattatcttgttctgaataaaatgtatttactccaaaaaaaaaaaaaaaaaaaa

SEQ ID NO: 502 - DNA, 1871 bp, Homo sapien
cgggcctgggcggatgtctccggcgcgtcggtgcagggggatgagggccgcggtggctgccagcgtggggttgagcgaggggcctgctggctcccggagcggtcgcctcttccgcccgccgagtcccgctccggcggcccccggcgcccggctgttgcggctcccggggagcggggccgtgcaggccgcgagcccggagcgcgccggctggaccgaggcgctgcgggccgccgtggccgagctgcgcgccggcgccgtggtggccgtccccaccgatacgctgtacggcctggcctgcgcggcgagctgctcggcggctctgcgcgctgtgtaccgcctcaagggtcgcagcgaggccaagcctctggccgtatgcctcggccgcgtggccgacgtctacagatactgccgtgtgagagtacctgaggggctcctgaaagacctactgccaggaccagtgaccctggtgatggaacgctcggaggagctcaacaaggacctaaacccttttacgcctcttgtaggcattcggattcctgatcatgcttttatgcaagacttggctcagatgtttgagggtccgcttgctctcactagtgccaacctcagctcccaggccagttctctgaatgtcgaggagttccaggatctctggcctcagttgtccttggttattgatgggggacaaattggggatggccagagccccgagtgtcgccttggctcaactgtggttgatttgtctgtgcccggaaagtttggcatcattcgtccaggctgtgccctggaaagtactacagccatcctccaacagaagtacggactgctcccctcacatgcgtcctacctgtgaaactctgggaagcaggaaggcccaagacctggtgctggatactatgtgtctgtccactgacgactgtcaaggcctcatttgcagaggccaccggagctagggcactagcctgacttttaaggcagtgtgtctttctgagcactgtagaccaagcccttggagctgctggtttagccttgcacctggggaaaggatgtatttatttgtattttcatatatcagccaaaagctgaatggaaaagttaagaacattcctaggtggccttattctaataagtttcttctgtctgttttgtttttcaattgaaaagtaattaaataacagatttagaatctagtgagagcctcctctctggtgggtggtggcatttaaggttcaaaccagccagaagtgctggtgctgtttaaaaagtctcaggtggctgcgtgtggtggctcatgcctgtaatcccaacattctgggaggcccaggcgggagaactgcttgagcccaggagttcagaatcagcctgggcaacatagcaatactccgtctcataaaaattaataaataaaaagtctcaggtgaccaaaggctcctgaagctagaaccaggtttggataaagattgaagagccacaggccactcttccctctgagccattgggcctagtggtgtcatgtattgtaattgctcgcagggagagcagtctttttggtgtaatagtgggatgtctgcttagttggcaggggttcagtccaaatggaagaatattgggaaataaacctccactatcctttatagccagggacttttttcttatttattcataaaataaattatagttaattatacccataacacctttatttaaatccagtgttctccgcagccttttgtctatttatatgtgtaccaagtgttaaacataattattattgggcatttgaactttgtttttctttaaagaaatgctgctattaaacatatttgtaaatggtttaaaaaaaaaaaaaaaaaaaaaaaaaaaaaaaaaaa

SEQ ID NO: 503 - DNA, 2780 bp, Homo sapien
gtggaagagccatccagagtgagtgcctggggcagagtgagagcaggaccagcgggcaggtggcggagcgggggtcggtggtggatggcccagccctggaaagccgaggtgaaggttacgagtccctgaggatctgtgggtgtgagccagccgcgtggccctgggcaacggcgctgccggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcagggcgcattgccgcccagaggaagatcctggctgcccagggccagctctcggcccaggggggtgcccagccctcagtggaggctccagctgcccctcggcccacggccacccagctgacccgcgacctgctgcggagccgtggcattgccggtctctacaagggactcggggccacgctgctcagggatgtccccttctctgtggtgtacttcccgctctttgccaacctgaaccagctgggccgcccggcgtccgaggagaagtcgcctttctacgtgtccttcctggccggctgtgtggctgggagtgccgccgctgtggccgtcaacccctgtgatgtggtgaagacgcggctccagtcacttcagcgaggcgtcaacgaggacacctactctgggatcctggactgtgccaggaagatcctgcggcacgagggcccctcggccttcctgaagggcgcctactgccgcgcgctggtcatcgcgccccttttcggcatcgcacaggtggtctacttcctgggcatcgcggagtccctgctggggctgctgcaggacccccaggcctgagcccagcacccgctccaccccagccagctgggcagggccggtgtggggctggagccaggcagctagcccaggacggagcaagggaagacccctccccagccctcccgtcggcaggggcagcagggggcagggtgcagggtccacataggtggtgcacacgcaagccccccggggtgctgcctgcaccgttgggatcaatgtctcatttatgtagaaaatgcagaaatctttacattcctcaagctagcccctgccccaatcctgccctggcctgaacacccccagggacagagctggtctctgggctgggggcccccgggcctgggccgggcaggctggaccatacccccagtccaccagctccagtctccacagccatcctggcccacacaggcaccccacacaaacctgtttattgaatctgctggacccaagcggctctccagcccttccgtccttccccagccgctcttgtcgccttggcaggacttgactctgcctccctggccagccttgcaagaggactggggtctcctgccctctctgttgagccaggaatcccaagtgaggggttgccctgaggtctgactcttggggcaagcccgccacccactgtgggactttctggtgggctcctcagctcccaccccaggctggggcccagattgtgaggtctgtgtgcatgtgtgtgtgtatgtgtgtgtgcatgcgtgtgtgtgttgtggggatctggcctggcccttggggatggggctgctggggactgccccccttcccgccgtggccaggcgctctgtgtgctgtgtgtgccccaggctctgttgaccccgtccaggaactaacttacccagcttggtctctcctgagtcctccaccctggcctgggattggccagggagcagggcgggcattgggaccagtgtggagcctgagggtgcctgccctgctctggagggagggccaggagctgccacacccccaagtcctctcagggcccaccctcctttttcagcctctgcataaggcccctgggtacactgcagaagccccatccttcccgcctccgggcataaggcccctgaccacacttcagaagccccatcccccctgccaccgggcgatccctgctgtgagccgaagctctccctgccccgccctggccatgtgatcgtgttggtgacagaccctgatgtgctggtgctgtgtccccaaaaccggggccctccacagaggccccttcccagcgacactacctggggctcaggcctggacccccccagttcacggttgctcctgggagctgcccctcccgtcacatcagaaccttggaagctgctgctgctgcttacagaattatatttttttcttttgaagagttttaagaagttgtaactttttgtgtcttgtcatgtcagagaataaataaatattctaagtagaaaaaaaaaaaaaaaaaaaaaaaaaaa

SEQ ID NO: 504 - DNA, 3558 bp, Homo sapien
cataacaagccaaacgccagaccgagagtgcctccgtgcgcgagtgcccggtgtgtgcgcgccggcgagagcaggggcccgcccggctccccgcccgccgcggcccgaactcatgcagctccgagcgagcgagcggcgcccagcccagcgcctcggccgaacccctccgcagcaggctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtgagcattggcagcccagagaagatggagcccatcaccaaggtgtcacacattcccagcagccggtgggcgctagtgtgcagcctctgcaatgagaagtttggggcctctatacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggtaatgattgacactgacaccttatagtgacttagagaagaagatgcaaagaggcgaacgctcgcccagagcaagaaatgatagccagtcatatactctcagacccttgtacacaccacagcatgaggttgtgttggttaaaaatatttatgggctggtaaactcattgtacatatgtgcaaaactgctactgagtggggagcttctttgtggttttttttttttaaaaacactttcccattaatctttactgttttgtaagatcaaatggggtgtgtcttccccacccccattccttcattctagagctagagtgaatgagccccaagaaaatgacccaaggagttgactcaggatggtttacagactgatttagaaaaccagaacggatttcatttctaatggagggggccagagatgggaaaatttcttgttcagtccggggaaacacacctaggtgctggtgatgggcttatgaaggaagctaagcacggctgctcactggcccccactttgtttcttgggtaattcacaggggaattcccagtactgtcatggagcagagcaggcagtgggtgctgatgtgtgtgcatgagctgtatgtacacatgcatatatctgttacagaagatactcctggcagtgaggtgctaagtcatcactgaggctgtgtgtgtgtgtgtgtgtgcgcgtgcccgtgtccatccatgtctctgttgtgtgtctgtgtgcgggtatgggtgggattcctggtggacaggggtgtcagatctgtctgaggagccccagtcatgctcagcacgctacagatgtgttgtttgtcacactgagattgctgaatgtcgtggctgttggctgccgagcctcagctgctggcatttccttctgctgtttgctgcttttgtgcctcccccactttccatcacctctggagtcccgtctggacgtcccttcctgctacaggaataatgaggcgtgggctgcctcccgctagggcctcctgctccctgtaggtagtttctggctgaggcttgctaattggggatgcttcttagagcatcttccacatcaactcccctggctgctggctaccgattaaattcattagtgtgaaagaggtgggagtgaggttttctggcctgaagcagtctgcactgaaaggtacccaagtggcctgaaacagtgtagggaaagacctgggaaacactggaccaaaaaagcctgatctcatggagacctgcatggccctgttagagatggcgtagaagtgaaagtcttaaagggagcattagagatccttttaatacacgactgagtgccagcttatttgtgatgccccttcccagaccaggttaggattcctgggaaggccgcggattccggccctggaagaggcaggatcctggagcagttttgtgaggcttttgtgctcccatacgccccctggtggtgagtgtaaagaagactttgcctctcacaactacatgtatgtgtggcatttttgttagagatgagaaaaggattgagaaggataaactggaatcctggtaagaagcctttatgccagcccgacacctgctgtaattggggtgcatgagctatggagtcagatagttgttgggagggggaggacaagaagtctattgtttggactgtgtttgtctcacaatcaccacaaaataaaagtgtagaaaatgcttgtggtgtactaactcttttctgtacttaagttactcagattaacatgcacttctaattctaaacattttttttggagtcatcactgtcgctgtttaagtagaacaatgccaacgatgtatgagaaacagggaataaatcaggatttgtgtgtgt

SEQ ID NO: 505 - DNA, 1575 bp, Homo sapien
ctgccacttccctctctcccctggcccgcaaagttttggcggagccatcgctggggctgagcgcgcccccggggggagatcggggagcgcccgatgccgggcggccggagccattgacccgggacgccgccgtccgctgagcagccgaccaccccgccgcctccggtgcatggggactggctgaggagccagcatgggcaactgcgtggggagacagcgccgggagaggccggcagccccgggacacccccgcaagcgagcaggacgcaatgagcccctgaagaaagagcggcttaagtggaagagcgactaccccatgactgacgggcagctgcggagcaaacgggatgagttctgggacacagcgcctgccttcgagggccgcaaggagatctgggatgccctcaaggctgccgcctatgctgctgaagccaacgaccacgagctggcccaggccatcctggatggagccagcatcaccctgcctcatggcaccctctgtgaatgctacgatgagctgggcaatcgctaccagctgcccatctactgcctgtcaccgccggtgaacctgctgctggagcacacggaggaggagagcctggagccccccgagcctccacccagcgtgcgccgtgagttcccgctgaaggtgcgcctgtccacgggcaaggacgtgaggctcagcgccagcctgcccgacacagtggggcagctcaagaggcagctgcacgcccaggagggcatcgagccatcgtggcagcggtggttcttctccgggaagctgctcacagaccgcacacggctccaggagaccaagatccagaaagattttgtcatccaggtcatcatcaaccagcccccaccaccccaggactgatgggcccacggacccctgggaagaggccccgcctggagcactaggcccccaccctgctgctgccttccagtgctgtcattttcttcaggggccctcccctcggtgtggctggtgggtgagccgtgaagggaccctgcctttcagggcactacgcgccaccagttcccggtacccagggagcaggcagccacacacgggccttgcaaccttgtcagagaaaaggcgaacagggccctcaccctgcctgtctcccgaagcaggttcgagccacaagggccaaccaggaggcccctggagcccagatctgtcatctggtgctgccagctgtgctcactctggttttctgctcagggtctgaagcagctgctgtctccctcctctgcccccatcccctggctctcccctgggcacagtgccactcccttggaagggagggaaccacccgtgagccccagggcttgggaagcctgaggcgggcctctgcttctccctgcccccagcacaattggcagagatgaggcgggtggtggacggctgggctgtcgtggcagggtctgcacagggccatgtcctggctgtaacccaggcagtgggaggtctgcagcctggtcatggcctccacagcaggtccctgtggacagacatatctgcatatttatcaataaagccttttgctccttaaaaaaaaaaaaaaaaaa

SEQ ID NO: 506 - DNA, 5090 bp, Homo sapien
aaggttaaaaatagttctcctgagaagcacattctggagaataagatagatgcaacaaaaatacatgttcccatggaaaccacaggggaccagggaattgaaggaatggcctatatggacgaaaatagaaatattacatttacctgtcccagaacaccatcagagctgataaataaatcatctcctctagaggttctggaatcagcagcctgtgaaaaactgcccactcctactcctcaagtagtaaaggaaggtgattcctttccagataccttggcaaaaaatgggcaagagatagccccagcccagatttccaaatcattaatggtagataactacaccaaagatggagtcccaggtcaagaaagacccaagggtccctctgctgttgtgccctctacaagcacaggaggagttgctctacctattacaacagccatagaaacagttaacattcatggagatcactctcttaagaataaagctgagcttgctgattccatgaaaaatgaagcagggatcgatgaagggcatgtgataggagaatctgagtcagtgcacagtggtgcgtctaagcattcagtagagaaagtcacagagctagcaaaaggtcacctccttcctggagtgccagtagaagaccagagcctaccaggagaggccagagccctagaaggatatgcagatagaggtaatttcccagcacatccagtgaatgaagagaaagagactaaagaagggtctgttgcagttcagattcctgacttactggaagacaaagcacaaaagctcagtttttgtgaggaccaaaatgctcaagatagaaattccaaaggttcagatagtttgaataagaaggtagatctgactcttttgtctccaaaaagtgaaaatgataaattgaaagaaattagtctggcttgtaaaatcacggaattggaaagcgtttccttgccaacaccagaaatccagtcagatttcttacatagcaaagtcgaagctcctccttcagaggtggcggatacgttagtaataatgactgcttccaagggtgttcgactcccagaacccaaagataagattttggagacacctcagaaaatgacagaaaaatctgaatcaaagacaccaggagaagggaaaaaggaagataaaagcagaatggcagaaccaatgaaaggctacatgagacccaccaagtcccgaggacttactccacttttgccaaagtctacaatccaggaacaagagagacataagcaactgaagtccgctggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatcaaaaaaaaaaaaaaaaaa

SEQ ID NO: 507 - DNA, 2905 bp, Homo sapien
agcgttgggccgcggtcgcggggccgtctcaggctgccgtcccgcccctcccgtccggccgccgccgccgccaccgccgccaccgcctgggggttggttgaggcggacggcggggtccgggccggagtacgtcgttcccgctgcgctaggggaagcgggcagtcagaaaaatgggtaagaagagtcgagtaaaaactcagaaatctggcactggtgctacagcaactgtgtcaccaaaggaaatcttgaacctgaccagtgagctgctgcagaaatgcagcagtccggcgcctggcccaggaaaagagtgggaagagtatgtgcagatccggactctggttgagaaaatacggaaaaagcaaaaaggtctgtccgttacttttgatggaaaaagagaagattactttcctgatctaatgaaatgggcctctgaaaatggggcttctgtcgagggttttgaaatggttaacttcaaagaagagggctttggtttgagagcaacaagagatatcaaggcagaagaattgtttttatgggttccacgaaaattgctaatgactgttgaatctgctaaaaattcagtgttggggcccttatattctcaagaccgaatccttcaagccatgggaaacatcgcactggcctttcatttgctgtgtgagcgagccagccctaactccttctggcagccctatattcaaaccctccccagtgaatatgacactcctctctactttgaagaagatgaagttcggtatcttcagtccacacaagctatacatgatgtcttcagccagtataaaaacacagctcgacagtacgcctacttctataaagtcatccagacccatcctcatgccaacaaactacccttgaaggattctttcacttacgaggactacaggtgggcagtctcttctgttatgacgaggcaaaaccaaattcccacagaggatggttcccgcgtgaccctggctctgattcctttatgggatatgtgtaaccacaccaacggcctgatcactactggttacaacctggaagatgaccgctgtgagtgtgtggctctgcaggattttcgggctggagagcagatttacattttttatggcactcgatccaacgcagagtttgtgatccacagtggttttttctttgacaataactcacacgacagagtgaaaataaagcttggagtgagtaaaagtgacagactctacgccatgaaggccgaggtcttggctcgtgccggcatccccacttccagtgtttttgcattgcattttaccgagccgcccatctctgctcagcttttggcttttctccgagtattctgtatgactgaagaagaactgaaagaacacttgctgggagacagcgctattgatagaatcttcaccttggggaactcggaatttcctgttagctgggacaacgaggtcaaactttggacatttcttgaagatagagcctcacttcttttaaaaacatataaaacaactattgaggaagataaatccgtcttgaaaaaccacgatctttctgttcgtgcaaaaatggccatcaaattgcgcttaggtgagaaagagattttggaaaaagcagtaaagagtgcagctgtcaaccgggaatactatcgccaacagatggaggaaaaggctccgcttcccaaatatgaagagagtaaccttgggctgttggagagcagcgtgggggactcgaggctccccctggtcttgagaaacctcgaggaggaggctggagtgcaggatgccttgaacatcagagaggcaatcagcaaagcaaaggccacagaaaacgggcttgtaaacggtgaaaactctatccctaatgggaccaggtccgaaaatgaaagtctcaatcaagaaagtaaaagagcagttgaagacgccaaaggatcttcttcagacagcactgctggagttaaggagtagctcgaggtgaagctggatgggggatccagtggagcaggagttgacggacagtccgttcacatcgctgtgtttccttgttaacatttttctttctgcagagaggaagatatgtttttgctgctttatataaaaatggtttttttaagttattttaaaaatctagcttccctttttgattaagattgccatcttgcttttaggcaaaacaaaccaattaacaaacaaccacaagaaagggagaagaggtgcctgtgggagattttgcagacctattgtgggtataggtattttcttcctggggaagaattcagttcccgtctcagctgtacttttgtgggcctgtcatcttgatgaccagaatgaaagcttgctctgcctcctgccagccagaattggtggcgggacttggggatacagcgtgaaggtggggaagttgcacagcagaaaacagaattgaagttgggaaactctagagtctgggcaaaatgtttggttttttctcttaaaaaaaataacaccccattaccaaaagaaaaggtaaggtggcaaccttatttttaatagtttgaaatgatgataatcctaattatataaaaatatatatataaacacacatatatatagtgatttctaaagatttgtttacttttgtgttttgttttactgtactaagaacttgtcctttctccttgaatcaaagtaggacatgcatcatcctcctaattttaaatgttggctctgattttaaagtggtgcatttgattccagccttggtaatggagagtttgcaaacacacagcggcccacagcttcacgtggtggtgtgcagtgtgaggcagctccttggctttcctggttttcacaacaagctagagattttcaaagctacacttttgagtaaaaacccttattaaaagaaaaacatgattaataaaaaaaaaaaaaaaaaa

SEQ ID NO: 508 - DNA, 800 bp, Homo sapien
gctctgttgctgtgcctagtctagtgtcccccaaagcatcggggggccacgcaagtgtgggtgtgtgagtgtgcgtatgtggggaccccccagggcatggtggggtctgaggcgtgtgttcccatttagggctgaatgaagccatgacttggaaaggtggtggggggtggatggcggctgtgactcagggcccagggatcacatgggggtcactgctgccatcagcagtcaggcagggagaacagaaatgcaaaaatacagatgtgtctatttttctaaactggggggtggaggggtgcctcctgacagcttccaaagagctgactgtggagggcccacagtgtatcccacccctgcccgagagtctctctcctttgggacccccgggttcccagagctccgaggaaactgatccttcatgtttcaatagctgttgttgtttttctctttgggccgggccgggccggggaagggccgagcaggctccaggaggcctccagagtcagctggaccttgctgtgtcgcccgcaggcagccctgcagacaccggtgaggtgggatgatttcaggaggtcccagcccgggactgcccgcccctctgccctgggaaccagtccaaggggctgtcagttgaatttgcctttttgttgttgttgttgtttttgttgtttatttgttctccttttaaggaattatgaagctaagaaaagttttgtgttttgggggttggtggacaaagttctagctgattaaatatggtctaacttaaaaaaaaaaaaaaaaaaaaaaaaaaaaaaaaa

SEQ ID NO: 509 - DNA, 2568 bp, Homo sapien
gcgaagctgagaggcctatggatgaggaggacgcggcggccccggtttgttctcatgaacaagatggatgacctcaacctgcactaccggtttctgaattggcgccggcggatccgggagattcgagaggtccgagctttccgatatcaggagaggttcaaacatatccttgtagatggagatactttaagttatcatggaaactctggtgaagttggctgctacgtggcttctcgacccctgaccaaggacagcaattattttgaggtgtctattgtggacagtggagtccggggcaccattgctgtggggctggtccctcagtactacagcttggatcaccagcctggctggttgcctgactctgtagcctaccatgctgatgatggcaagctgtacaatggccgagccaagggccgccagtttgggtcaaagtgcaactccggggaccggattggctgtggcattgagcctgtgtcctttgatgtgcagaccgcccagatcttcttcaccaaaaatgggaagcgggtgggctctaccatcatgcccatgtccccagatggactgttcccagcagtgggcatgcactccctgggtgaggaggtgcggctgcacctcaacgctgagctgggccgtgaggacgacagcgtcatgatggtggacagttacgaggatgaatggggccggctacatgatgtcagagtctgtgggactctgctggagtacttagggaagggcaaaagcatcgtggatgtggggctggcccaggcccggcacccactcagcacccgcagccactacttcgaggtggagatcgtggaccctggagagaaatgctacatcgccctggggctggcacggaaggactatcccaagaacaggcaccctggctggagcagagggtctgtggcttatcatgcagacgatgggaagatcttccatggcagtggtgtgggggacccctttgggccacgctgttacaaaggggacatcatgggctgtggaatcatgttcccccgggactacattttggacagtgagggggacagtgatgacagttgtgacacagtgatcctgtctccgactgcccgggccgtccggaacgtgcggaatgtcatgtacctgcaccaggaaggggaagaggaagaggaggaagaggaagaggaagaggatggggaagagatagagccggagcatgagggcaggaaggtggtggttttcttcactcggaatggcaagatcattgggaagaaggatgctgttgttccttctggaggcttcttccccaccattggaatgctgagctgcggggagaaagtcaaagtagatctgcaccccttgagtggctagggcctcccctccagacctgctccttctccctgctcaccctctgctgggccaggcacccagttcctgacttcccagaggcttcgtttacccagcaggcccctggaggtgtgtagtcactctgcccccactggctcaggcccctgtcacgcttctctgtgcccacgtttctgacctggtgctgccactgttgtcagtccctgggcctgagtccctggttggacaggaatggacccaaagaatggtgttggtatgtgggtggtcccactcgctttggtcagtgggcttctgggtccccctttccctcaccggccctgtgtgggtggagaggcgtgagcaccctatctcagctgctattcgggcatgatgctttgtagagggtagagtagacagccccctcccctactcaccatggtatttctccttgaattcctctttcttgttttctttcctggttgtgtgaaccagttgctgctgtcatacccctggcagggccaggggacctctctttggtcatctctgtcctttcactggctgctgccccaggaagactcctctaggctctccatctttcccttgagagctggctccccaccccaacctgctcaggcaccacagaggatctaggtctctggctccccatacctggacccacatgggtgggtgcctgttgcatgtttaagagagaggggctgtgaggtgacagggcactagggccttcactcctttctccccttccatcctttctttaccagtgccacccatgtccctagctcccgggtattggggctgaggctctggggcctgtctccctgccagcgtgagggcaagaccccagagccttagctgagcaagcccagaggggcagcgtggcccctccctccccttttcctgccccgtcccatgcctcagcttgctgcttgtgccagttgcctgtttcgcttcagtgtttgattctagcacttacatgtgtcctccccaccaagccctctatctccttctaatccttcaacccctggccccctccccgtaacagtgacttttccagggaggaagaggcagcaggagctgttggccttggtttgcacagagcgggtagggctgtagggaaagcgggtgagctgttgtgctgctgggcctccctttggccctcgcttcccaccctacgatgtatgaaatgtatgtacagaccagagatgtttatacagccgataaagatgg

SEQ ID NO: 510 - DNA, 19271 bp, Homo sapien
ggctctgattcagttttctttttcttctcttttccttttttttttttttttttttttttttttaggaatgcagagcagttgctggggtgattgacctaggcacagtggagatatttcccatcttcaaagccatgcaaaagggcctccttgaccaagacacaggcctagtgcttctggaatctcaggttatcatgtctggcctcattgcccctgagacgggtgaaaacctctctttggaggagggcatagccagaaacctcattaatccccagatgtaccagcagctccgggagctacaggatgccctggccttaataagcaggcttactgagagcagaggccctctttctgtggtggaagcaattgaaaagagaataatcagtgagacagttggactgaaaatcttagaagctcacctggcaactggaggtttcagtctttcccctagtgagaactgtattaacctggaagaggcttttcatcaaggcctcatttctgcatggcttcattcagtattagagtcttatcttagaacatccaagaatttgatagaccctaacacagctgagaaaattggtttgctggatctgatgcagcgatgtattgtccaccaggaatcaggattcaaattactgcctgtcaaacaattggcaggggggatggtgagcttgaaatcaggccggaaggttagcattttccgtgcagttcaggaagggctaatagataggcaggtcactgtccggttgctggaagctcagctttttgctggtggcatagtagatccaagaacaggacacagacttacagtggaagaggctgtaagacataatctgattgaccaagatatggcctgtgctatcctcataaggcagcttcagacaggaggcatcatagacactgtcacggggcaaaggctaacaatagatgaagcagtgagcaatgatctagtagctgctaagatcgcccttgtgattctggagtccctctggtcattcatggggttgctgtggcctgaatctggagagatcctcccaattacagatgccctagaacaaggtattgtgtctactgaactagcacataaaatccttagtaaccgacagcatattaaggctctgtttctaccagcaaccacagagattttgtcctggaagaaagcaatagaaagtggtatcctggatagagatcttgccaataacttaaaatcgatttgtatacctgatgtgatgccccacatgcaactagcagactctgcagaacaaaatattaatcctggagcagcagttctaccgtgcagcaagagccaccctaaggccacagcaagccagagtgagaatctgttgttccagctgatgactcacagctatattaatgtgcaaaatggacagaggctgcttctgttagataaagagctgatggagacactaacatccagagatgagtatcaaacaagtcctccaaaagtggttgaaattgggcatcaaaggcaaaaaactcctgagggattgcaagaatcagctaatgtgaaaatctcaggaactttcagcagtgggtggactgtgaggctgcctgagttccagttttcttctcagaacaaagaatatcccgatcgggaagattgcactacagaaaaaggcaaaaagaccactgtagaaacagaagattcttctgtagagaaccctgaacaggatctgtttgtagaacaaaaagagagaaatccaaacattgatgctttgaaggtaataaataaagtcaaattagaggtacaaaggcagttgataggtacccaaagggaagaccaaacagcagtgtctgtcagagaaaatgccagcaggggacacctcctgaccatacctcctgctgaggcggaaggtgtgccgttggtggttgacaaagatgttttttctgttgaaacaccaaagaaagaacatcaacctctaagaaacacttcctttacatgtcagaatgaacaagcacacactcttgagactgaatatattcatgatgaaactggaggatctcacataaaaccccaaagcaaaaagttacaagttcaggtaaagaaaactctaggtataaagttagaactaaagtctgaaactgatgggaatgttcatcctctggacaaaaaggaaatgttaaagaaaacatttctggctaaggatgaccataaagaaagtcaagaagcacagaacatcgcaggtggtagtatgatgatgtcagaaaagaccgatgaggaagatagtggcagggaaatttttctgtcatgcagtcatccattagaattgcttgaagaagctaccttaaatgtattatctgcacagttactagatggtggtatctttcatgaacaaacaggtcaaaagctcttactaaatgaagcaatatcccgaggcattgtgccaagtcacactgccgtgaagcttatggagaagctgaacatgtttcaggggttctttgactctcagacttgtgagtctttgacaactgaagaagtcattaatgaaggtctgatggatgagaaattattacataatgtcctcatggcagacaaagctataagtggtgtcttagacccccgtacccagacactgtgctctgtaaaggatgcagttacagttggacttcttgacaaggaaacagccaccagaattttagagaggcaggtggtgactggtggaattattgatctgaaacgaggcaaaaaagtttcagtaactttggcctcaactcttggcttggtggacgttgctgaccagccagaacttataaatctggagaaagcttccaaaggtagagatgctgaaaaaacagttagggagagattaattagtttacaaatggaaacaacaggacttatagaccctgatagtaaagcacctttaacagttgtgcagtccattgacagaggtcttttggagagagaggaggccgttcgtttgttgactaagcaagtggtagatggaggtatcattcaccatatatctgggatgagactttctgttgataatgccttcagacatggcttaattggtgaagatttagccgagaaactcaaaagagttgagaacttaaacatccatcagatttttaatcctgaaacgaaggaaaatatttccctccctaaagccataaaattagatcttattacctcagacctgaaaagagaaatccaggaggttcaggcctttactggaaactttgtggatctcatttctggtcagagattgaccttggcagaagctaaaaaagaaggactgttaactaatgaagcagtattgtctccaggaatgatgcatggcattgtagatcccgagaactgcagaattgtcccctactcagaattagtcaagaaatgtaagattgatattgaatctggacagagatatctagaagtaattcccttctcagacattaaagatggggtgagcgacaaagtgcttacattgtctcaagcaattcagcttggaaaagtagactttgcatctacgctgaaggttctagaagcccaggcaaatactggtggaatcatagatactgctactggaaaaagactgacattggcatcagctttggaagagaaactggtggatgaaaacatggtcagaattattgcatctcatcaggtgttaaatggaggaattgttgacatatttagtgatcagagagtgactttagtagaagctattgagaaaagactgatcagccctgaactggcaaatatgatccaaatagatagttcagagttcagcgatcacagggctcagattgaaaagcaagaagggattgaagtgtgtgcattacaaaatgaatttctaggaaaggatatgttaattgcttgtaatcagactgctgaaatgagttgtaataaagtagaagagagtgagagattatttcaagttgaaaatcagtctgcacaagaaaaggttaaagtgagagtttctgatggggagcaggcaaaaaagagcagggaaatttccttaaaggaatttgggtgcaaggatcaacgtaagccaagaatgtcttcagatgctaaagaatttatcagtatcataaatcctcataatcttaaaggtaaatccttgggccaagtgtcattgacacacccttactctgaatgtgattttaaacttaaagaagtggctagaaataacatgggaaatgatacaaatgaagagcaggaaaaagcagtgacaaaaatagaaattatttctcatatgaagcagtctacctcatgtctagattctgaagaaataagagaaaatcaaggggaagtgattttggaagtacaagaaacatattgtgaaacgtcaggcaaattgccgagtgagcaggttttgcagcaaccaatgaatgctcgggtgaaaagtaagagagagaagagggaggtgattgtagaagaaagtatcagaacatgcaaaccagcatttctttctgaagaaaagttgtatcaggaaactgccattagagatgagcatgactcccatataaagagccaacctagggaaatgacctcaagtgaaaaagggaaagaagctgatacagaaatgggattttctattacttttaaaattgaagagtcctcttcccaagtggtacctcaaggaatttctgtaaaacatttagatgctttaacactcttcagctctaaacaggccaatgaaggaaaagtaaacaatttaagtctctgcttgactttaaaaccagaagaaaacttatctcgagaaattgcctgtggggcccagagtgaaccattcccttgtatgaccccaagacctgaaggattgcactaccaggaatcagatggaaaagcccaagtgacaggcccatcccaaatttccaaaacagacaagtctttccaaggaaccaccagacaggagaccaactatcaagattcctgggttacttcgaaaactaaggaaaccaaacatcaaatttcctcatctaatgaatgtaaagaaaagtcataccaagaagtatcttttgacccagcaagaggtcttaaattggaagaaatcacagtttctagaccagattcaaaagaagtcaggtatctagaattctcagacagaaaagaccttcatcatcagggcagcaaaagtgatgataaactttgtggaactctcaaatctgaaatagcaacacaggaactaactggagagaaatttctagaaatggcaaaccctaatgttgcaggtctagaagcaggatccattgaggacatagtgactcagagaggttccagagtcttgggatcctttcttccagagaaactgttcaaaggagtgtctcaaaaagagaatacagggcaacagaatgccatcattagtcctactgttctagagaccagtgaagaaaagacagtgtccctaacagtatgctctgcagtgaagacagagaagacaccacaggaaaagctcagagaaagccctggcagtgaacaaactcccttcatgactgcacctgaaggaaagggaaatggaggtgtaaacccagagcccttcagagcaactcagaatgtatttacccggcaactctgtttagaacatgatgaaaagctagtatcctatctgtctctgttacggaacattgaaatgaggaccaaacagattcaacctttggagctaaacctggcagaactacaggatctgctgtgtcaggccaaggtattagaaagggagttaaaggatctgaccaccttggtcagtcaggagctggagtgtgtgaatcagattatcatcagccagcctcaagaagttcctgctcaactgttgaaggctctagagaaagatgccaagaatcttcagaagtctctcagctctgtgagtgacacttggaattccaggctactccacttccagaatgctgtggaaatagaaaagactaaagtgttaaatcagcacacacagctagaaggccgacttcaagatctgagagcctgggttggcaataaaaatcttattctgaacagcaagggatctaacagtgaaatagatgttgacagcctgaacctctgcctccaacagtatgaggatttgaaacagcccatggctgaaaggaaagctcagctggatgctcttgcttttgatattcagttctttatctcagaacatgcccaggacttgtcccctcagcagaatcgacagatgctgaggcttctgaatgaactgcagaggtccttccaggacattttggaacagactgccgctcaggtggatgccttgcagggccatcttcaacaaatggagcaggaagccctggtgaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacaggttccatactgccctctgtaggaagctctgtaggcagtgtaaacggataccacacctgcaaagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatagtcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggttcttcctcggcaatcagtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaatattttgtatttcctgattttcttttcaactattaccttatctataaatgttaccctggggtataatcatgttgtaggtacttaaatgcattccgcaaatcaaaatatcttgatggataaattatagagctt

SEQ ID NO: 511 - DNA, 3896 bp, Homo sapien
ccttccgcagctgccgcttcagtccgaaggaggaagggaaccaacccactttctcggcgccgcggctcttttctaaaagtaatgtgaaaacctttgcatcttctgatagtctagccaaggtccaagaagtagcaagctggcttttggaaatgaatcaggaactgctctctgtgggcagcaaaagacgacgaactggaggctctctgagaggtaacccttcctcaagccaggtagatgaagaacagatgaatcgtgtggtagaggaggaacagcaacagcaactcagacaacaagaggaggagcacactgcaaggaatggtgaagttgttggagtagaacctagacctggaggccaaaatgattcccagcaaggacagttggaagaaaacaataatagatttatttcggtagatgaggactcctcaggaaaccaagaagaacaagaggaagatgaagaacatgctggtgaacaagatgaggaggatgaggaggaggaggagatggaccaggagagtgacgattttgatcagtctgatgatagtagcagagaagatgaacatacacatactaacagtgtcacgaactccagtagtattgtggacctgcccgttcaccaactctcctccccattctatacaaaaacaacaaaaatgaaaagaaagttggaccatggttctgaggtccgctctttttctttgggaaagaaaccatgcaaagtctcagaatatacaagtaccactgggcttgtaccatgttcagcaacaccaacaacttttggggacctcagagcagccaatggccaagggcaacaacgacgccgaattacatctgtccagccacctacaggcctccaggaatggctaaaaatgtttcagagctggagtggaccagagaaattgcttgctttagatgaactcattgatagttgtgaaccaacacaagtaaaacatatgatgcaagtgatagaaccccagtttcaacgagacttcatttcattgctccctaaagagttggcactctatgtgctttcattcctggaacccaaagacctgctacaagcagctcagacatgtcgctactggagaattttggctgaagacaaccttctctggagagagaaatgcaaagaagaggggattgatgaaccattgcacatcaagagaagaaaagtaataaaaccaggtttcatacacagtccatggaaaagtgcatacatcagacagcacagaattgatactaactggaggcgaggagaactcaaatctcctaaggtgctgaaaggacatgatgatcatgtgatcacatgcttacagttttgtggtaaccgaatagttagtggttctgatgacaacactttaaaagtttggtcagcagtcacaggcaaatgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgcaaaaagaaaaaaagaaaagaaaaagaaaaaaatcccttgttctcagtggtgcaggatgttggcttggggcaacagattgaaaagacctacagactaagaaggaaaagaagaagagatgacaaaccataactgacaagagaggcgtctgctgtctcatcacataaaaggcttcacttttgactgagggcagctttgcaaaatgagactttctaaatcaaaccaggtgcaattatttctttattttcttctccagtggtcattgggcagtgttaatgctgaaacatcattacagattctgctagcctgttcttttaccactgacagctagacacctagaaaggaactgcaataatatcaaaacaagtactggttgactttctaattagagagcatctgcaacaaaaagtcatttttctggagtggaaaagcttaaaaaaattactgtgaattgtttttgtacagttatcatgaaaagcttttttttttttttttttgccaaccattgccaatgtcaatcaatcacagtattagcctctgttaatctatttactgttgcttccatatacattcttcaatgcatatgttgctcaaaggtggcaagttgtcctgggttctgtgagtcctgagatggatttaattcttgatgctggtgctagaagtaggtcttcaaatatgggattgttgtcccaaccctgtactgtactcccagtggccaaacttatttatgctgctaaatgaaagaaagaaaaaagcaaattatttttttttattttttttctgctgtgacgttttagtcccagactgaattccaaatttgctctagtttggttatggaaaaaagactttttgccactgaaacttgagccatctgtgcctctaagaggctgagaatggaagagtttcagataataaagagtgaagtttgcctgcaagtaaagaattgagagtgtgtgcaaagcttattttcttttatctgggcaaaaattaaaacacattccttggaacagagctattacttgcctgttctgtggagaaacttttctttttgagggctgtggtgaatggatgaacgtacatcgtaaaactgacaaaatattttaaaaatatataaaacacaaaattaaaataaagttgctggtcagtcttagtgttttacagtatttgggaaaacaactgttacagttttattgctctgagtaactgacaaagcagaaactattcagtttttgtagtaaaggcgtcacatgcaaacaaacaaaatgaatgaaacagtcaaatggtttgcctcattctccaagagccacaactcaagctgaactgtgaaagtggtttaacactgtatcctaggcgatcttttttcctccttctgtttatttttttgtttgttttatttatagtctgatttaaaacaatcagattcaagttggttaattttagttatgtaacaacctgacatgatggaggaaaacaacctttaaagggattgtgtctatggtttgattcacttagaaattttattttcttataacttaagtgcaataaaatgtgttttttcatgtta

SEQ ID NO: 512 - DNA, 6146 bp, Homo sapien
taagagagggcggggggaaggaagaggaggcgggatccgggcgctgcgttggctgcggcctggcaccaaaggggcggccccggcggagagcggacccagtggcctcggcgattatggacccggccgaggcggtgctgcaagagaaggcactcaagtttatgtgctctatgcccaggtctctgtggctgggctgctccagcctggcggacagcatgccttcgctgcgatgcctgtataacccagggactggcgcactcacagctttccagaattcctcagagagagaagactgtaataatggcgaaccccctaggaagataataccagagaagaattcacttagacagacatacaacagctgtgccagactctgcttaaaccaagaaacagtatgtttagcaagcactgctatgaagactgagaattgtgtggccaaaacaaaacttgccaatggcacttccagtatgattgtgcccaagcaacggaaactctcagcaagctatgaaaaggaaaaggaactgtgtgtcaaatactttgagcagtggtcagagtcagatcaagtggaatttgtggaacatcttatatcccaaatgtgtcattaccaacatgggcacataaactcgtatcttaaacctatgttgcagagagatttcataactgctctgccagctcggggattggatcatattgctgagaacattctgtcatacctggatgccaaatcactatgtgctgctgaacttgtgtgcaaggaatggtaccgagtgacctctgatggcatgctgtggaagaagcttatcgagagaatggtcaggacagattctctgtggagaggcctggcagaacgaagaggatggggacagtatttattcaaaaacaaacctcctgacgggaatgctcctcccaactctttttatagagcactttatcctaaaattatacaagacattgagacaatagaatctaattggagatgtggaagacatagtttacagagaattcactgccgaagtgaaacaagcaaaggagtttactgtttacagtatgatgatcagaaaatagtaagcggccttcgagacaacacaatcaagatctgggataaaaacacattggaatgcaagcgaattctcacaggccatacaggttcagtcctctgtctccagtatgatgagagagtgatcataacaggatcatcggattccacggtcagagtgtgggatgtaaatacaggtgaaatgctaaacacgttgattcaccattgtgaagcagttctgcacttgcgtttcaataatggcatgatggtgacctgctccaaagatcgttccattgctgtatgggatatggcctccccaactgacattaccctccggagggtgctggtcggacaccgagctgctgtcaatgttgtagactttgatgacaagtacattgtttctgcatctggggatagaactataaaggtatggaacacaagtacttgtgaatttgtaaggaccttaaatggacacaaacgaggcattgcctgtttgcagtacagggacaggctggtagtgagtggctcatctgacaacactatcagattatgggacatagaatgtggtgcatgtttacgagtgttagaaggccatgaggaattggtgcgttgtattcgatttgataacaagaggatagtcagtggggcctatgatggaaaaattaaagtgtgggatcttgtggctgctttggacccccgtgctcctgcagggacactctgtctacggacccttgtggagcattccggaagagtttttcgactacagtttgatgaattccagattgtcagtagttcacatgatgacacaatcctcatctgggacttcctaaatgatccagctgcccaagctgaacccccccgttccccttctcgaacatacacctacatctccagataaataaccatacactgacctcatacttgcccaggacccattaaagttgcggtatttaacgtatctgccaataccaggatgagcaacaacagtaacaatcaaactactgcccagtttccctggactagccgaggagcagggctttgagactcctgttgggacacagttggtctgcagtcggcccaggacggtctactcagcacaactgactgcttcagtgctgctatcagaagatgtcttctatcttttgtgaatgattggaacttttaaacctcccctcctctcctcctttcacctctgcacctagttttttcccattggttccagacaaaggtgacttataaatatatttagtgttttgccagaatctctcttgctttgccattaagcagaagaactagtttccctgtatagcctgctgggagagacccacttctagggtatgggggatgcagcttcaagcccagtgcccagtgtctccctgttaactgcaggaatgccaagcacctggccagagcagcccagccccaatatgcttaggaggagacagagttccctctgtatagcctctgggacaagaaaaagaaaacacaagaatgtatacactggaagatttgggcctcctgcctgccttctctttgtttctgttcctcttcccatctactcccctacgccccttcaaccttttttctctgtctgcttcacctgagaagaaagtgtacgaagagagtgtcctcctctcacatgagccagatcagccagaaaatgcaacacttggaagagttaaatgctgttcagtgaagatttcagccccaggcctttgctgcaagtgaccctgtggcaacagtggattctcagacatgatactctcatcatatttgcaactcttctctctctttcttccccacacccaagaggaggattggtggtagggggcaggcagagggggtggggagaagtttcctgggctccatcaatggctgcatcttttctggactcagcagtctccttgattccatgtagagtgtggaaaggagttgctgattgcatttcctctcattaacaattgggtgtgtaataaaaagcattgtacttcatcttaaatcactggtaaggctcagcctacagaaagatttgaaatggccagagccaatcgcttggtgcattctgcgtaatggtttccatctccgatttcctcatcagggcctgtgaatacccaggtgcctgtatctttgccaagaccgtgatcaaggtagcttaagagagatggtcaggagaaaacactgtttttgttttttttgttgttttgttttgttttggccagttaaatatcatctctcaaatattgatctcaccgtgtcaaccttgcactgcacaaccttccttctgcttctcccacacccagtatttgcagaagggcaaagctgcttaagagagaggatcagggtgaagtttggcacacagggtttattaatggggcaaaaactgccttttcttcctcctcctgaccttattttgctcttcactctccccagccaataaagcgtctgtggcgattggtgaacagcataaacagctggacctcagcaagggtcaggcaaacccagtcactcggaaggcagctgtgtgagctgccaagctagtgggcttcaggtgcaagggtacctgtgccacaccaacctgggagcacacagaatactattaatgtgcacccagctggtctccccaggcaagaaggtatcctcttcccaaggtgtacccactgaatgttgttactacatattgagagtcattttatgcatatgcattctacctttcctgctttatgagtatttttaagcttttagttcaaggttatattcagaaaatatttcccagtataatgatacatcgtagcctaagaaatattttctcaatgtaattcccttcccagctacccaaatgctacagagaaatgttttctacttggccactatcagggttcgtcatctattgtgttgactattaatggctttttgattgggtaaggattttgctatagatgaaggtagagggctgtcagccctgaaaaacacacaggtcagacatttaaaaggcatgggtttcgagctgtctcaaaatattgcccaatagccataattttaccagcctttctgtcatatgctgctattacaaagtggaagctgttgaatgtttattggtgcccagggttttgctctccaatctaggttcagttgaaggaatattgtttctaagactgttttgagacatgtccagtacatcacaaaggagatcggggcgacccctgcagatgtggagccattagcccagttgaggatattctccaagttgtcctctctcctgctgatggaaatgggaatgaagttaagtggtctgaaaaacttgaatcgttcacatttctcagctctgggggtcatttaccagtttgttgtagaagaaataatcaggtaagttaaaagttcatttccagagaaggtaaaccccacttaccatctctgcatgatttcagtgggaattgattatcactaatccccaactgggctagaataaatgtaaagtttgacctttttaaaacgaaaagagagacaaagtctcagcacattccaaggagtggtagaaacagagctgaaggtgtccccattgtagattagtctcttctcactaaaatttactttccaacgtagggcctaaaggaaacctttcttaaagacaggctgaaaccccttcaaaggcagatgaggaggtacagacacgtgaccttttggtgcacactggagctacttggacaagaccagcatgccttgctgcacgtgtgtgtatttcactgctgagaacatcctttaacttggtgtgcaatttgaaaggatgtgaatcatggatggaaggccatttgtacatgtcccttggcaaaattctttctggtgtctcctaacttcagagacagggactctttttggatctctattgacaagtaataaaagtctggccctcataacttgtttccgaactagaaaagtctgtgagacccctacatcattctggtttttttgcttgagtaagaacaatccttttttatttttcttctgtacagtctaaagctacagagaaaaaaaaatgcactcttcccttgccggctcctggtaccattggtctgaacagctgtagttggtctactccttacttagcacttgattgtgtggggaaacaaaggtgggaggggtggggaatactggaaataatcagggcaatttttttctttcccataattggactagataccttggtactgttgaccttctcagcatctcccttttgccttagatggcaacaccctccagtctgtagcagagcagtccaacccagattagtgcagcccggaggcttagggtgcagcctccctggtcttcctccacacagttgttcaccaacagaccagacctcctttaaccacagtgtcaacatagtatcggaaagagagccatttcttaggggaataaaacagtttcgcttctttagctcatctgtggtgtcagaatccttggagctgaagagagaaatcaaaagagcatgatgatggctgcctggtttcaggtggaacttaatgcattgatctttagaagctccttctgttggaagttgagtacctgtgatctaaaatgtcctggaggcagatgacatctaaaatatgtgctttccaaccagcacagctggcgctcttagctcctgattggttgtgtgttttattaaggatcagtgcagttaagtcgtattttaaagtgttacctcccctcctaacccttccccttcttggacactgaaggaaaaggccaactagggtgttagccctctgggcaccaaggaaactaacagctttctcaaagcggtgaccactcaggccagcccagacaaatctgagggatggccagtgcactccaatgatgggacaggcctaacaacacatgtaagcttccccgagagctttcagctggttcacctctttgttctctagactcttaagtactgactgctttgacttttgtgattatgttatggtgatgtgtagtcagtgtaccaatatgttcacaacctaggatcatgataatggagtgtgttttgggttttttttaactgttcagaaaaaaagtaaattacaaatataagattaaagtgaaaaaaaaaaaaaaaaaaaaaaaaaaa

SEQ ID NO: 513 - DNA, 2676 bp, Homo sapien
gcggggaagatggcggatgacaaggattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttccggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagcaaaaaaaaaaaaaaaaaaa

SEQ ID NO: 514 - DNA, 3646 bp, Homo sapien
ggggccagcccgctgacagattctcggtggcggcggcagcggcggcggccctggactgcggggaatgggaatcctaggtccctgactgagcacctcccccgcctccctgcccccgacatggctcaggagaagatggagctagacctggagctgcctccgggtacgggcgggagcccggcggagggcggtggcagcggcggcggcgggggcctcaggaggtctaacagcgcccccctgatccacggcctcagtgacacttcgccggtgttccaggccgaggcgccgagcgccaggcggaacagcacaacgttcccgagccgccacggcctgctgctgccggcctcccctgtccgcatgcacagcagccgcttgcaccagatcaaacaagaagagggcatggacttgatcaaccgagagacggtccacgaacgggaggtgcagaccgcaatgcagataagccactcctgggaggaaagtttcagcctgagtgacaacgacgtggagaaatccgcctcccccaagcgcatcgatttcattcctgtgtcaccagcaccgtcacccactcggggaattgggaagcagtgtttttcgccatccttgcaaagttttgtaagtagcaacggattgcctccaagccctattcccagcccaacgacccgatttaccacccggagaagccagagccccatcaattgcattagaccaagtgttcttggaccattgaaaagaaaatgtgaaatggaaactgaatatcagccaaagagatttttccagggcatcaccaacatgctttcttctgacgttgcacagctgtcagatcctggtgtgtgtgtatcttcggatacccttgatggaaacagcagcagtgccggatcttcttgtaactcaccagcgaaagtcagcactaccaccgactctcctgtgtcacctgcccaagcggcttctccatttattccactagatgaactttcgtctaagtgattcactcatcctgagactttctttttgcagtggagagagagaataatctagttggggcaaacactgaactttgtcaattaatttgaggctatttcctatttgaccccttttcttttttgaaattccctgaaatgatgttattctagagaacttctatgtcaggttcctttggatacccttgaattcagtgtagtaatattttcagacgtttccccaataagtgtgttgaagcatacatctttacgctgctaatatgtctaaatacatatgttatcccttgatttttttaaataactgagagctctatttatttatgggattattaagttctgatgaaaatataaatgttgacttaatcagcatagtaaactgatgtttaaaattccatacttcatgcccacactaatttttaatgttattttcagtggttgccgatttccatttgatgaagaactatacagcttaaaaaaatacgttagttatatctatctagtggttgtctgttttacccaggaattcttggatatttagttttctgggtactgaagtggatgggagggggaatgattaaagaacaaattataaaagtttgaacaaatcttttcaaattaagtatataaaagtaaacttttaagaaaaacatttttaatgagattttaatagtaattctagtcagtcatacaactataactactatagagaaaataaaattttttcctttttttttttaaccggaaagtgcatttgcttgggtgtaatcctaaagtgaaatgggacagtgccttgcagtctttgcccactgtacataggctaaggctaagctctttgtactactgcaaacttaaaagtttttcaaatgtgggaaacgtgtgggaaggcttgttgaactttggcgcactcaggtaaacaatactctctcaattgttgatatactttaaaatattcagttgtgcctcagttccagaaattattgccaaacaggagccacagcaatttttggctacttttctgctctgcccatctgtcaccttactggttttcccttgttcaggaaggaagcagctgtttccttgccaacaggtcccttcctctccatctcccaccaaactagggcaccattgattagacaaaggtacagtgtaacttgggtttctgacagcaacaacaggactgtgaattgtttaacctctgtggttaaagctacagcttgagttgactgccttggggatgtcagttaattaaggggtgatgatttgcaagagaaaattagtggagagtcacataggtaaatcattatttaacttaggttttcctaaagttagaatagtcgaatgttcttttctttacctttacaattaagacaaaatgtttaataagaatagcaaaaatttttttatattatgcatccttatacctcacatatcttccttaactagatagtttgacagaaagaatggcatacaaagaggaaaggggaaaaatgactcagaacaagacaaaagctctgactgtttaaagttatcgcttacagagactttaacaattttgtggaatttttacaactatgagagtaaatggaactggtcaactcttgacagttgcctcaagatggagtgaaattgcatcgagggtaagactgtgtccacaggtttaaaattctctcttctgagtaatagtgttcatgtgctcccattctcgaccctgttgttgaaattcaaacttaaatagcctgacttcttgttgggtaacttgccctgcctccagaggtatttgaacttcattatcttcagcacaggaattgttaatcttctcacttcacctgttcttgcattagctcaattgatgtcatcactgatttcctaaactagaaactatggaagcatctttgacttttccttttctctgttggattagcttaatcaccaagtcctgtcaacttctgaaatgaatctcaaatttcttcccttctctatctgttgcccctgattttgccttaagttcttgcctgagtgatctcccagcctgtcttctgtctccttttggttcagtctttatactgcctcttgagtaatctttctgaaatttaaacttgatatttttcgccctcttgcttgaaaacttcacttgcttccccatttcctactctttaaggaatgatttctttagcctcagatagaaggacctttatgatctggccatattctgaaatagcttcaatcctctcctcatctctgttccagtatacatctttccttcttattctgcaaacattagaccacttgatattctttaaatatgtcatgtacttttcttgtgtctgttctttgggataattcctatccttttcagggaggcaaattgcacgtgagtttaagtatgaaggcaatgtatacctgctgattgtaaaatatttaaacattgtacatatctgtgtggttttaaaagtctgcttttaattatgtaaaattcatcttccctttccacagataacttctgttaacaacttgatatctattgtacaagatgtgttactggcatttccatgtatatatgtatataaatgcaggaaaccaacatgtcattgacacctctcttctttacttttccccatatctaatcattcctcaagtcttactgatttttatcagctagaatctatctcctt

SEQ ID NO: 515 - DNA, 1893 bp, Homo sapien
aagtaagtatccccactttcagggtagcatcctctttccctagttatttcagtgcagaatcgattcacgtgtaagcctctacctcctgcacttaccccaatgtagacccccttccacagtccccctacagaagatctcccaaaacatttccaacacagaacttccattcaattcccctccgactgcccgcctccctcctccaggacagagcacgccccaggtttcgagactgaactacccccatctacggagtccacccctccctctctagaaccccctcagtgtagacgcctcctcttttcctctttcctccctactttttctagtttttctgcagccgacctccagcgtcggccactgtagctccttccttgctccactttccccagagtacacagcctgcctttccactctccgtgcagacccatcctctttcccgctcctcgctctcggacgccaccaacgctctcccgggctcttccgcgttacctacgatggaaggtcggggcgtgcgggcagctggaacccacccctgtcttggagctccgggtagctctcaaactcgaggctgcgcaccccctttcccgtcagctgagctctagagcgctggggctttctttttgatcgacttcttgaaataaaaccaactttatcattctttgggtaacagacccaaaagccgatgggacggcccgctgggctgttcccgcccctatgcccttttttgggtttccggccagaggcatgctgggagcgtcacatgcaaattgagcgtgcacccagcgttccgccctttctacgctgggccggttatcgacccggcccagtgcgcaggcgcgggaaagttgaactaataaagtttgtacgagttcagtggaggagaccgcaagttgagtggaggaggcggcggtggggccccggaccaggtgcctccatggcaggctctgaagagctggggctccgggaagacacgctgagggtcctagctgccttccttaggcgtggtgaggctgccgggtctcctgttccaactccacctagaagccctgcccaagaagagccaacagacttcctgagccgccttcgaagatgtcttccctgctccctggggcgaggagcagccccctctgagtcccctcggccttgctctctgcccatccgcccctgctatggtttagagcctggcccagctactccagacttctatgctttggtggcccagcggctggaacagctggtccaagagcagctgaaatctccgcccagcccagaattacagggtcccccatcgacagagaaggaagccatactgcggaggctggtggccctgctggaggaggaggcagaagtcattaaccagaagctggcctcggaccccgccctgcgcagcaagctggtccgcctgtcctccgactctttcgcccgcctggtggagctgttctgtagccgggatgacagctctcgcccaagccgagcatgccccgggcccccgcctccttccccggagcccctggcccgcctggccctagccatggagctgagccggcgcgtggccgggctggggggcaccctggccggactcagcgtggagcacgtgcacagcttcacgccctggatccaggcccacgggggctgggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaagtaaaaaaaaaaaaaaaaaaaaaaaaaaaaaaaaaaaaaaa

SEQ ID NO: 516 - DNA, 1772 bp, Homo sapien
gagtagagtagggcaggagaaactgggccaggctgcacttagctcaaggggcctcgaggactctctgcgtctctggagacaagggcactacacgcacttcagaatgaagagttgcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcaaaaaaaaaaaaaaaaaa

SEQ ID NO: 517 - DNA, 1701 bp, Homo sapien
actggttgcggagtgagctgggcgcgcggcgcgcaggcgccctggggacccggtagcggcggtggcggtggcggcggtggcggtggctgcggcgacggcagaggcgaagggagccggatcgccgacctgagcgggaggcggcggtggcggccatggcggcagatggagagcgttccccgctgctgtctgagcccatcgacggtggcgcgggcggcaacggtttagtggggcccggcgggagtggggctgggcccgggggaggcctgaccccctccgcaccaccgtacggagccgcatttcccccgtttcccgaggggcatccagccgtgttgcctggggaggacccacccccctattcacccttaactagcccggacagtgggagtgcccctatgatcacctgccgagtctgccaatctctcatcaacgtggaaggcaagatgcatcagcatgtagtcaaatgtggtgtctgcaatgaagccaccccaatcaagaatgcacccccagggaaaaaatatgttcgatgcccctgtaactgtctccttatctgcaaagtgacatcccaacggattgcatgccctcggccctactgcaaaagaatcatcaacctggggcctgtgcatcccggacctctgagtccagaaccccaacccatgggtgtcagggttatctgtggacattgcaagaatacttttctgtggacagagttcacagaccgcactttggcacgttgtcctcactgcaggaaagtgtcatctattgggcgcagatacacacgtaagagatgtatctgctgcttcttgcttggcttgcttttggcagtcactgccactggccttgcctttggcacatggaagcatgcacggcgatatggaggcatctatgcagcctgggcatttgtcatcctgttggctgtgctgtgtttgggccgggctctttattgggcctgtatgaaggtcagccaccctgtccagaacttctcctgagcctgatgacccacagactgtgcctggcccctccctggtggggacagtgacactacgaagggagctggggtagttaaaggctcccggggcttctagaaggaagccaagcagctgccttccttttccctggggagaggtaggaaggaaccaggccctcacttaggtttggaggggcagataagagcactgctgaccatctgctttcctccaagggttctgtgtctagggtgaagtaggcaaaacgttgcccttaaaactgggccctgaagacggttccagccttgtccttcctgtgtgctccctgagagccattcctgtcccttacacattccagggcagggtgggggtgggtagccctgggggttcccctccctcttgtgcaccattaggactttgctgctgctattgcacttcaccagaggttggctctggcctcagtaccctcagtctcctctccccacattgtgtcctgtgggggtggggtcagccgctgctctgtacagaaccacaggaactgatgtgtatataactatttaatgtgggatatgttcccctattcctgtatttcccttaattcctcctcccgaccttttttacccccccagttgcagtatttaactgggctgggtagggttgctcagtctttgggggaggttagggacttatcctgtgcttgtaaataaataaggtcatgactctaaaaaaaaaaaaaaaa

SEQ ID NO: 518 - DNA, 1502 bp, Homo sapien
attgggacgctgcggcctggccttcaggccactggctaccgaaccccggggctcttcaccagtccagctcgtttccagcaccatgtcggtgcggacgctaccgctgctcttcttgaacttgggcggggagatgctttacatcctcgaccaacggctgcgggcccagaacatcccgggagacaaggcccgcaaagatgaatggacagaggtggacagaaaacgagttctgaatgacatcatctccaccatgttcaatagaaagtttatggaggaattattcaagcctcaagagctctactccaagaaggccctgaggactgtctatgagcgcctggctcatgcctccattatgaaactgaaccaggccagcatggataagctctatgacctgatgaccatggctttcaaatatcaagtattgctgtgtccccgacccaaggatgtgctgctggtcactttcaatcacttggataccatcaagggattcatccgagactccccaaccatcctgcagcaagtggacgagactttgcggcagctgacagaaatatatggtggtctctctgcaggggagttccagctgatccggcagacactcctcatcttcttccaagacctgcacatccgagtatccatgtttctaaaggacaaagttcagaataataacggtcgctttgtgttgccggtgtccgggcctgttccttggggaactgaagttccaggactcatcagaatgttcaacaacaaaggtgaagaagtgaagaggatagaattcaagcatggtggaaactatgtccctgcacccaaagaaggttcttttgaactttatggagaccgagtcctgaaactgggaactaacatgtacagcgtgaatcagcctgtggaaactcatgtgtctggatcatcaaagaacttagcctcatggacccaggaaagcattgctccaaaccctcttgctaaagaagagctgaatttcttggccaggctgatgggagggatggagattaagaaacccagtggccctgagcccggattccggttgaatctctttaccaccgatgaagaagaggaacaagcagcgctaaccaggccagaagagttatcctatgaagttatcaacatacaagccacccaggaccagcaacggagcgaggagctggctcgaatcatgggggagtttgagatcacggagcagccaaggctgagcaccagcaaaggggacgatttgctcgccatgatggatgagttatagctgttctgaccaggcgtcctctgcccccagggagaggctgctggatggtgacccctggggaatgccccatggcccagaatgatgctgctagttttctactgagtgaagccattacgtctatttcttatttatgttgtaaggaactgtgtgagtctcccttgaggagcactcactcttgaaggcacacacatacacatattttcagtgaaatatattctgacttttaaacttgaaaaaaaaaaaaaaaaaa

SEQ ID NO: 519 - DNA, 2807 bp, Homo sapien
caggttgggttctgggacaggtgacccggcggcggggcgaggcagctggcggcgtcgcatggagggctctgggggcggtgcgggcgagcgggcgccgctgctgggcgcgcggcgggcggcggcggccgcggcggcggctggggcgttcgcgggccggcgcgcggcgtgcggggccgtgctgctgacggagctgctggagcgcgccgctttctacggcatcacgtccaacctggtgctattcctgaacggggcgccgttctgctgggagggcgcgcaggccagcgaggcgctgctgctcttcatgggcctcacctacctgggctcgccgttcggaggctggctggccgacgcgcggctgggccgggcgcgcgccatcctgctgagcctggcgctctacctgctgggcatgctggccttcccgctgctggccgcgcccgccacgcgagccgcgctctgcggttccgcgcgcctgctcaactgcacggcgcctggtcccgacgccgccgcccgctgctgctcaccggccaccttcgcggggctggtgctggtgggcctgggcgtggccaccgtcaaggccaacatcacgcccttcggcgccgaccaggttaaagatcgaggtccggaagccactaggagattttttaattggttttattggagcattaacctgggagcgatcctgtcgttaggtggcattgcctatattcagcagaacgtcagctttgtcactggttatgcgatccccactgtctgcgtcggccttgcttttgtggtcttcctctgtggccagagcgttttcatcaccaagcctcctgatggcagtgccttcaccgacatgttcaagatactgacgtattcctgctgttcccagaagcgaagtggagagcgccagagtaatggtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcggcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattacttttttcttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaaaattaataaactgttacttatatttaagaaagtgaggattttttttttttaaagataaaagcatggtcagatgctgcaaggattttacataaatgccatatttatggtttccttcctgagaacagtcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacagggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagccacatttttgtattgttactgtacgtgtatctggggcttctccgtttgttaatactttttctgtatttgttgctgtatttttggcataactttattataaaaaaaaaaaaaaaaaaaaaaaaaaaaaaaaaaaaaa

SEQ ID NO: 520 - DNA, 3699 bp, Homo sapien
gagtccggcgggcggctcctcggggttgggcgaccgagcggggccggccgggcggggggcgggcccgtgaaggcggcgcagcgcggcgcgggaggcgtgctgggcgcggggctgcggtgcccagaggctgcggcattaggggctcggcgcccccgaccttccgcgtcccggggtggcggcggcggcggcggcggcggcgcgggcggcatatgatgctgagctggctgctccagaatgaaccacagctctgagaaggggaagtagaaacagctggcgccctgccatggcctgtgaaccacaggtggacccgggggccactggcccattgcccccctcctcccctggctggagtgccctgcctggagggagccctcctggctgggggcaagagctccacaatggccaggtcctcactgttctccggattgacaatacctgtgcacccatctccttcgacctgggagccgcagaagagcaactgcaaacttggggcatccaggtcccggctgaccagtacaggagcttggctgagagtgccctcttggagccccaagtgagaagatatatcatctacaactcgaggcctatgcggctggcctttgctgtggttttctatgtggtggtgtgggccaatatctactctaccagtcagatgtttgccttggggaaccactgggctggcatgctgctcgtgaccctggccgcggtgagcctgaccttgactcttgtgctggtctttgaaagacaccagaagaaggccaacaccaacacggacctgaggctggcagctgccaatggagccctcctgagacaccgggtgctgctgggggtgacagacacagtggaaggatgccagagtgtgattcagctttggtttgtctacttcgacctggagaactgtgtgcagtttttgtctgatcatgttcaagaaatgaagactagccaagagtccttgctgagaagcagattgagccagttgtgtgttgtcatggagactggggtgagccctgcaacagcggaggggcctgagaacttggaggatgctcctctcctgcccggcaattcttgtcctaacgagaggccactcatgcagactgagcttcatcagcttgttcctgaggctgagccggaggaaatggcccgccagctgctggcagtgtttggcggctactacatccggcttctagtgacctcccagctccctcaggcaatggggacacgacacacgaactctccgagaattccatgcccctgccagctcatagaagcctacatcctaggcacagggtgctgcccgttcctggcgaggtgacctagggatgaaggtactcatcttccttcaagactgagcagtcaggaaggcttcaggagcccaagatggccaatggggagccccaggtgaggagagaagcatctgggggcactccaaaaggggcctgtgatgtcagccactggggtgttgtgctcacttcagggcccagcacaaaaatccttgtttgacatctcatgctgaccccctggcctttgcagaagctgatggttacagagctagtcccaccaaagctactctctctgctgcttagaactgtggacacgtatggaaagactggacccccattgctttcattgttcagagaacccaggagacatgaagatgaccagactgggcaaattatgtgtccaaaacttggcctcagatgatgtttccatctccaaccccttcatgccagatggggaaactgaggctcagagaggatactgctctatgtggcattgccttgaacccctaaaattatcagacttcctttttccaatataaagaaaaaaagtaagttttcagaattctctcaatttttaagtttttctcccccatattttgtgaaaagcagtggtatgtgtacgtgttgtctaccagtacacaggctgcagaagacagagacagaagaaagagatcaagggcagataactgttgataggaatatttgagaaagattgatcctgtttgacttgaggacttattttgttcacaggcatgcacgcttgtggttgtggttttatattacagatgtagaacaatggttatgtttcccgacatgaacattgtcctggaatgaagtgtgatcagccacttgtggaattctttgaagagctcagaggcttccaagtgatctgctcctgaacaagtttgaagacctattgtttcatagacccaagaccaaacgcatctaaaggatccccagcccccaagacctagcctttgtctgcgattttggcttcatctcccacaaaacccctttatgagttcacgctctttcctggactgacatacctattcctttccatttgttggactcctattcatgcttcaaagtccagctttcttaagcccttctttaggaagccttcccacacagccaaccctgctgctctctgcctcctttaaattcttgatacagctgctgcttgttctgatgttttatggtattgattctgttttcctgtgtatatgccagtttttctagctagactgtaaactccttaaggacagagactacaccttgtactttttgtgcatgacctggacctgctaaggaaaaaaaaatcttgtggattgattgctttgccatccccacagcagcttttgcaaattgctttccaaactcacttgaatgatgacattgctgtggacctgggttctggacctgatctgccacttcaagctgtgtaatttttggcaagttgctttctttgcctggtcctcagtttgcccatcaatataatgggtggattggatgatttttttttttttaattgagatggagtcttgcactgtcacccaggctggagtgcagtggcgcgatcttggctcactgcaacccccgccacctaggttcaagtgattctcatgcctcagcctcccaagtagctgggactacaggtgtgcaccactactcctggatatttttttgtgtttttagtagagatggggtttcgccatgttggccaagctggtcttgaactcctgacctcaggtgatccacccgcctcgggctcccaaagtgctgggattacagacgtgaggcaccacaaccagcctggatgattcttaagggcccttctaggaccaaagttctgggaatttctagcttattctgccccctcatagcccttggcctatctatctttatccacatgcagaaacatctggcaaccccacatggctgagatgacctggtcctaggacacccttggacagaagactggcctacctagcagacctggatttttcttcctgatctgctgcttccaagttgtgtgaccttggctaagtcacttaacctttctgattgtcatttcgctttttaataaagtgggtctggtgaacaagaaatgtaataaacacgtggcttgccattcaagagatgagtctgaccattcactttctgtgtgccagagaagagagatcatgggtatagaccagcccctggaaaggctgctttggtcaaggctgagagcagctttgctcaaggaaattattcacgaaggtgaccactgtctttcggacctggcacagaggaaatgttggctgtgaatgtgaccaatagaaagaagcccgtatttctcagtcagtcctagaaccccggtaagtaattaacagagaataaaaatgtgtttgttaaatgaaaaaaaaaaaaaaaa

SEQ ID NO: 521 - DNA, 2994 bp, Homo sapien
ggagctttcgctgttcggggcccggcctgctccgggccctcccagcgtcgccgctagctgacttagggctcccgcccacactgcgcacggccttgctgagggccggctcgtagtgggaggcttcgcgttcacctgaacatttccgcctcctctggatgggggatgagaggcggggctgatgcatcgcagcagtcctggaccctgacttcggacttggagaagaaacgccgaggaggaacgggagttagggggttagcagcttggcgcgctgggagccggccacccctggtctccggacttcacttcccaggaggcctcgcgcgcgactggaagtgctgcgagcctataagaaggcgaggcggcacccgccgctctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcaccaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcctgggtgctgggcctgccctctccggccgcttgctgcctgtctgctttccttggtggctttgcctgggtgctgggcctgccttctctggctgcttgctgcctgtctgctttccttggtggctttggcttctgcactccttggcgtcagcctctcaggtcctccattcacacgaggtcctcctcgctctggccgctcttgctgctcctgtctgaagaaatcagactgatttcctcttaagactcctagggatgtggtgaagagctgggactcaagtgcagtccacggtgtgaaacatgagggaggtgaggtgtccgtccacttcccccataaaggtgtgcatttcagttaggctgccccgccacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggctccacctcttccagctgctgctacagctgaggcctggatcccggcctttccctgtgacttacgtgtctgtcaccggcaggcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcagctgatgccaaagttgtggtgtccagtgtgcagcagccctgggagccactgccaccttcagaggggttccttgctgagacccacattgcttcacctggccccaccatggctgcttgcctggcccaacctagcgttctgtgccatgctagagcttgagctgttgctcttcttcaggggaggaaatagggtggagagcgggaagggtcttgctcctaagtgttgctgctgtggcttttttgccttctccaaagacgcactgccaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccgtctccataggggtaggcatttcactggtttatgaagctcgagtttcattaaatatgttaagaatcaaaaaaaaaaaaaaaaaaaaaaaaaaaaaaaaaaaaaa

SEQ ID NO: 522 - DNA, 4335 bp, Homo sapien; identical to SEQ ID NO: 372

SEQ ID NO: 523 - DNA, 3055 bp, Homo sapien
cgcggggatggaggcagggaggggggacgatggcgggacgggtggcgccggggttccagccctgcgcctgctccggagcaccgggcccctctcgctgaccccctcgtcccaggaccccgcaggcccgagtgcctgggctcgtcctctttcgcgcccgctgccaggtgccagggccgcgcaggcgggcggaggacagaagtcggtcctaggccccccaggctctgaccttctttcccaggatgaggtggggccaccatttgcccagggcctcttggggctctggttttagaagagcactccagcgaccagatgatcgtatccccttcctgatccactggagttggccccttcaaggggagcgtccctttgggccccctagggcctttatacgccaccacggaagctcggtagatagcgctcccccacccgggaggcatggacggctgttccccagcgcctctgcaactgaagctatacagcggcaccgccggaacctggctgagtggttcagccggctgcccagggaggagcgccagtttggcccaacctttgccctagacacggtccacgttgaccctgtgatccgcgagagtacccctgatgagctacttcgcccacccgcggagctggccctggagcatcagccaccccaggccgggctccccccactggccttgtctcagctctttaacccggatgcctgtgggcgccgggtgcagacagtggtgctgtatgggacagtgggcacaggcaagagcacgctggtgcgcaagatggttctggactggtgttatgggcggctgccggccttcgagctgctcatccccttctcctgtgaggacctgtcatccctgggccctgccccagcctccctgtgccaacttgtggcccagcgctacacgcccctgaaggaggttctgcccctgatggctgctgctgggtcccacctcctctttgtgctccatggcttagagcatctcaacctcgacttccggctggcaggcacgggactttgtagtgacccggaggaaccgcaggaaccagctgctatcatcgtcaacctgctgcgcaaatacatgctgcctcaggccagcattctggtgaccactcggccctctgccattggccgtatccccagcaagtacgtgggccgctatggtgagatctgcggtttctctgataccaacctgcagaagctctacttccagctccgcctcaaccagccgtactgcgggtatgccgttggcggttcaggtgtctctgccacaccagctcagcgtgaccacctggtgcagatgctctcccggaacctggaggggcaccaccagatagccgctgcctgcttcctgccgtcctattgctggctcgtttgtgccaccttgcacttcctgcatgcccccacgcctgctgggcagacccttacaagcatctataccagcttcctgcgcctcaacttcagcggggaaaccctggacagcactgacccctccaatttgtccctgatggcctatgcagcccgaaccatgggcaagttggcctatgagggggtgtcctcccgcaagacctacttctctgaagaggatgtctgtggctgcctggaggctggcatcaggacggaggaggagtttcagctgctgcacatcttccgtcgggatgccctgaggtttttcctggccccatgtgtggagccagggcgtgcaggcaccttcgtgttcaccgtgcccgccatgcaggaatacctggctgccctctacattgtgctgggtttgcgcaagacgaccctgcaaaaggtgggcaaggaagtggctgagctcgtgggccgtgttggggaggacgtcagcctggtactgggcatcatggccaagctgctgcctctgcgggctctgcctctgctcttcaacctgatcaaggtggttccacgagtgtttgggcgcatggtgggtaaaagccgggaggcggtggctcaggccatggtgctggagatgtttcgagaggaggactactacaacgatgatgttctggaccagatgggcgccagtatcctgggcgtggagggcccccggcgccacccagatgagccccctgaggatgaagtcttcgagctcttccccatgttcatgggggggcttctctctgcccacaaccgagctgtgctagctcagcttggctgccccatcaagaacctggatgccctggagaatgcccaggccatcaagaagaagctgggcaagctgggccggcaggtgctgcccccatcagagctccttgaccacctcttcttccactatgagttccagaaccagcgcttctccgctgaggtgctcagctccctgcgtcagctcaacctggcaggtgtgcgcatgacaccagtcaagtgcacagtggtggcagctgtgctgggcagcggaaggcatgccctggatgaggtgaacttggcctcctgccagctagatcctgctgggctgcgcacactcctgcctgtcttcctgcgtgcccggaagctgggcttgcaactcaacagcctgggccctgaggcctgcaaggacctccgagacctgttgctgcatgaccagtgccaaattaccacactgcggctgtccaacaacccgctgacggcggcaggtgttgccgtgctaatggaggggctggcaggaaacacctcagtgacgcacctgtccctgctgcacacgggccttggggacgaaggcctggagctgctggctgcccagctggaccgcaaccggcagctgcaggagctgaacgtggcgtacaacggtgctggtgacacagcggccctggccctggccagagctgcccgggagcacccttccctggaactgctacagggtgtcgccatccagatgtgttggaagcttcccctcctgccttatgctcacctgtggacaccgaggatgccctcacattggtgctttctcctcatcctcatgccccctttgccacaatggtatgatggcttggtagcccctcgaggcagatgcacctgacttgctgctattaaaaagccgtgtgccttctaccaaaaaaaaaaaaaaaa

SEQ ID NO: 524 - DNA, 2901 bp, Homo sapien
gccgggagtcggtgaggcggctgcaggtccctccctgcggagccgctggtccggctggcggagatgtgaccgcgggcccggccggcctgcctcaggcgtcgcgtcagctcccgtgtccgtgcccttaacccacaccgatggcgggatccggctgcgcctggggcgcggagccgccgcgttttctggaggccttcgggcggctgtggcaggtacagagccgtctgggtagcggctcctccgcctcggtgtatcgggttcgctgctgcggcaaccctggctcgccccccggcgccctcaagcagttcttgccgccaggaaccaccggggctgcggcctctgccgccgagtatggtttccgcaaagagagggcggcgctggaacagttgcagggtcacagaaacatcgtgactttgtatggagtgtttacaatccacttttctccaaatgtgccatcacgctgtctgttgcttgaactcctggatgtcagtgtttcggaattgctcttatattccagtcaccagggttgttccatgtggatgatacagcattgtgcccgagatgttttggaggcccttgcttttcttcatcatgagggctatgtccatgcggacctcaaaccacgtaacatattgtggagtgcagagaatgaatgttttaaactcattgactttggacttagcttcaaagaaggcaatcaggatgtaaagtatattcagacagacgggtatcgggctccagaagcagaattgcaaaattgcttggcccaggctggcctgcagagtgatacagaatgtacctcagctgttgatctgtggagcctaggaatcattttactggaaatgttctcaggaatgaaactgaaacatacagtcagatctcaggaatggaaggcaaacagttctgctattattgatcacatatttgccagtaaagcagtggtgaatgccgcaattccagcctatcacctaagagaccttatcaaaagcatgcttcatgatgatccaagcagaagaattcctgctgaaatggcattgtgcagcccattctttagcattccttttgcccctcatattgaagatctggtcatgcttcccactccagtgctaagactgctgaatgtgctggatgatgattatcttgagaatgaagaggaatatgaagatgttgtagaagatgtaaaagaggagtgtcaaaaatatggaccagtggtatctctacttgttccaaaggaaaatcctggcagaggacaagtctttgttgagtatgcaaatgctggtgattccaaagctgcgcagaaattactgactggaaggatgtttgatgggaagtttgttgtggctacattctacccgctgagtgcctacaagaggggatatctgtatcaaaccttgctttaatcagtaacctaaggactgtttcctttttctcctcttccatttcttgggttattccacatatgaatgcaggactacccccttaccattttaagaaggtactttatacatttatttaatcctactaatgtgcagccattgcccaagcagtgactgcgttgcatacatttggcactgagtaggacaagacctctcagctatacattgaggggttttagagcatccatgtgggcaacccttttttgtgcgggagagcaggtgttgctcttcagtatgtagcctaaaaaaatcttaattatttcatggatcatgaagcaaggatgaataatatcatgtcttggtaaatactaacaaatttgttaggtttggtgacatcatttacagattatttctttatgttgtccagtggttcttccttattgttgatatccataagctggcactggatgctctcagtaatgttaagtaattgtcaagcagcagttacctactgtgttcttaacactgagttgtgaattttttcttaaagcagtactgtagtactgaatattcctttaaaggaactgcagtgagcctatctaagtttttttaaattaaggcttttaaaatagaaagctgatgcttgatcttgcacaatttttatgtctagtatgtatgcttgagtgaatgtgtgagtatgaatgattagagaaaatttgagtcagtgtactttatagtgtgaatcctgtgagctaatacagtctatacttatttcttccctacctgtttcacatccgtaagatttaggatatacattttttgagaggtagtctgtctgatacaatgtaaatgacaaaacataattcctgagaggcccagaacaaactggagtctagcctggagttaaattgagacttctaaaatgattggaacaaagactaagttgtgccagatgtaaatcaacccctcttttagtttactttagactttgtattagctcatcttttttgtagtaaatctatagttttaaggtttctcaagatgtggctctacctactatgatgaaaattgaagtgggtcaaaagaattagatgtacagtgaagggaaaagaaaaaaaatgggcgaagagagggtggaaaataaaaggattcttttttcttcctttctgtttctcgtatccctgctccctttttcctccccttccctcattctttgcctctatccttagctgaagacaaactagaggagcagcatcccaggtagtttggcttttgactgcaaggtagttaagaaaggtgtagatataatgaggtagaagtagaaaggaagaaaaactcaaagaattctgaaaaggattcatagcaacataatgtgtccctgagtagaggatgctgctatgcgtgagttcatggacacaagttgattacatggtttttagaattataattatggattcttcttatttcatggtaggttgtctttaaagatataaaaattaggatgcctttatgaagcactgattatacc

SEQ ID NO: 525 - DNA, 2440 bp, Homo sapien
gggcgcggccgggtggtggcggtggctgcggcgacggcggtcgcgtcggcgtcagggtcggggtcggtaaggggtgcggcaatgctgcaactgcgggactcggtggactcggccggtacgagccccacggcggtgctggcggccggcgaggaggtgggggcaggcggcggcccgggcggggggcggccgggggcggggacgccgctgcgccagacactctggcctctcagcatccacgaccccacgcgccgcgcccgcgtcaaggagtacttcgtgttccggcccggcagcatcgagcaggcagtggaggagatccgcgtggtggtgcggcccgtggaggacggcgagatccagggagtgtggctgcttaccgaggtggatcactggaacaatgagaaggagcggctggtgctggtcacggagcagtccctgcttatctgtaaatacgacttcatcagtctccagtgccagcaggtggtgcggatagcgctcaacgcagtagacaccatttcctacggagaattccagtttccccctaaatcgctcaacaagcgagaaggttttgggattcgaattcagtgggacaagcaaagtcgtccttccttcataaacagatggaatccctggtctaccaacgtgccctatgccactttcacagaacacccgatggctggcgcagatgagaagacagcatctctgtgtcagttggaaagcttcaaggctctgttaatccaagctgtcaaaaaagcccaaaaagaaagccctttgccaggacaggcgaatggcgtgctgatcctggagcgccccctgctcatcgagacctacgtgggactcatgtccttcattaacaacgaggcgaaactgggctactccatgaccaggggcaaaataggcttttagccgctgcgttctgggagctcctcccccttctgggagctcctccccctccccagaaggccaagggatgtgggggctgggggactgggaggcctggcagtcttcatgctgccctgctgctgctggaaggatggggatctttcacctttagggatctcagcacaattagaatcgtaaagtgaattctatctatttaattggatattggactctgctcatataagctacagacaaaagccaaaagactctcgctgtccctgtgctgctggtatttcattctctgtaacttcagttctggtgttttccttgagtatctacttggcttctcgtggtttttcccaccccagctgccccagcacgcgggacccatagcacaccccttagcgcttgcctaggttgctgaaaacagggaggcacctggtatctcgagtgcctgcagttgcaagtatgtttacacctggtgtccaattttgtattttaaaatgtaatccatttttacttcagctcatccaaaagcagccagcagaccggttgactgagaccggtctgtggctgtgggccccttggtgacccgctgctcttttggaaatgggtgacctgaagtgacactttttccacaattaacccaagttgtgttaatacttcaggtctgtttcccagacccagaaagctttacagaaaatcattgtaagacaatttattaatttgagaaagtcaccttgacagttctttgcacacaagttttacacctctctggattcgaagtttgtattgtattcatagttaaagggaatcgggtactttgcttgttgaataatgcactttaaaacaaggaaccgtatcaggccagcatggtggctcatgcctgtaatcccagcattttgggaggctcaggcagacaaatcgctctagctcagaagttgcagagcagcctgggcaacatggtgaaacccgtctctaccaaacagacaaaaagcagccaggcgtggtggcacatctgtggtcccagctacttgagaggctgagccaggaggatcgcttgagcccaggaggcggaggttgcagtgagctgagatggcaccacttattgcactccagcccgggcgacagagcgagactccatctaccagatccttatgacgcagctgatgcctgccttggttcctaccactctggtgtagacagaggactttgtccaagtctcacactaaacatgcccgggcttcgatgtgcctggaggatttccccacagggacccacgcacctccctgtatctgcgcagcttgctcgtgtggctggaagcgctgtcgataagcttcacgcactggcttgccagttcttcagctctaggacttgtagctttaagcaaacggtgtggcatgggttgagtgtggccacctgcaggatgtgcagggctgcctcagaagctggctggggactctagcctctgtgttcataaagacattaagaagtggatggatgttgttccttttttgaagttgtcattaaagtaggtgcaacaaccaagaaaaaaaaaaaaaaa

SEQ ID NO: 526 - DNA, 3587 bp, Homo sapien
gaattcagcacaatgaaggagccatggaatgccaatttaacgtcagtcttgtacttgaagggaaaaaaaacacttgtaatggtggcaacagtgaagctgttcctttaacatccccaaatatagccaagtttagcactccaccagccatcctcagaaagaagagaaaaatgcgagtgggtcattccccaggcagcgaacttagggatggctcattgaacgatggtggtaatatggcgctaaaacatacaccactgaaaacactaccattttctccttcacagtttttcaacacatgtcctggtaatgaacaacttaatatagaaaatccttcatttacatcaacccctatttgtgggcagaaagctctcattacaactcctcttcataaggaaacaactcccaaagatcaaaaggaaaatgtagggtttagaacacctactattagaagatctatactgggtaccacaccaagaactcctactccttttaagaatgcgcttgctgctcaggagaaaaaatatggacctcttaaaattgtgtcccagccacttgctttcttggaagaagatattcgggaagttttaaaagaagaaactggaacagacctattcctcaaagaggaagatgaacctgcttacaaaagctgcaaacaagagaataccgcttctgggaagaaagtcagaaaatcactagtcttagataattgggaaaaagaagaatcaggcactcaactgttgactgaagacatttcagacatgcagtcagaaaatagatttactacatccttattaatgataccattattggaaatacatgacaataggtgcaacttgattcctgaaaaacaagatataaattcaaccaacaaaacatatacacttactaaaaagaaaccaaaccctaacacttccaaagttgtcaaattggaaaagaatcttcagtcaaattgtgaatgggaaacagtggtttatgggaagacagaagaccaacttattatgactgaacaagcaagaagatatctgagtacttacacagctaccagtagtacttcaagagctctcatactgtaattgttattaaaattgatgaaatgccccactcccttactgcagtctctactaaattaggttgcagtgaaatttttctcaattagttgtttttaaagttgtaagatacccttttaatacagcatcttttttctattctatatagtaggcagaaagctagtaagtcacttaaggggtagatagtttcatagtttattttttaagagatgagatttttaaaaattgtttttaaagaacaagatgggaaaataatagaatgttcatggatttctaaaagtaaattctcatatattttcttcacaagatatatgttgctactctcttgatgctgcagttttgttatagataggtgtatgagtatatatgatttctgaaattagtctatgtatggaaagcacacatgattttatgaaggtacttttgcccatgtgctgatttacttaggctaccatttacaaagaaacacattgaaaaggaatttaaaggaaggatagaaagttgcactactaattttttgttttttttttcagaagcagtaaaattaactacagtgttaaatgtatttatttgagcatagtactgaaaacaaaaagcattcaaaaaagagttttttctttattagtaaatagtattttcttaatctcagaggagctgagagttttgttgaatgtattgtacagtatgtaggagcaggagaactttgtaaattggaaagaagtctgtttttataatttatttttatttttaaagcttaaatgtagatatttatagtatacagggagcctagaagccaatgttgtttcctgttattacagctaacacagtaaagaataattttgactttaagtatgaaacagtagtaagttatagctgcaaagaatacaatatctatactgtatgtcacatctacctaaatgttgcactatgccctttaaatcatgctggttataaagtagttctaaaaatgtactaaataataatttaatattttctttttaaattatatcgggggtggtcatatacattaatctggtgatttgtatatgtgtttgaaattttttgcttttgtttaaaaaaaaataatatggtaccttggtccctaaaaacagtctgcacttagaagttatatttactcagtgtttcagaagtggagaacttatcttttatttataaaaatattttgtccttttttaaatgttttgtgtttctctacaggttacaacagttgcttcagttgcctgttttaggtgtttgcacttattttatttcttcttgaaagaatttttatttgcttttgtggtagagattatatgtaattttttttcagtcatataatggtgtgctgtcaacttaaacactgacaggtaaatagaattgtacactgtagtttgaattatttataattgacacactctctccctctccactcctgaagtatgctgctatagaaaatagcagaatcggcttgctgctacgagagaaggaaagagcgaccaccacttgcactgtgtgaaaagataaaaaacaaatgatggcaagttctcaagttaactaaatggaatcaaccattaccaggcaaattcttgcaaataccaaaatactactatgccttataaaacaaaatgaaagcaggttaagattttctgctctgtttgtatgttaatagaaatggaaatactaagtattttaatgcttagctattgaacagtagacctaaaagggttttaagctatttaaatctacttgctagtttttgcatattttatatatatatatatttatatatatatatagtgagaagtgaagaaaatgtatggtactaagattatgccttattgataaatagataaaccaatttgaatcctcttagcatgtttaagtatgttgattgctttctaattaatgaacttctcacagaaatttcacttagtgaaaccaatgattgtagcaaactcatactggatcatttcagttaccttgaactaatagcacataatggttttttgttgttgttgtttttaatgtagcccttacctggatatacatagtctgcaatcaccaaagtataatatcttgtaaggctatattttttaaagcatattttttcttgagcattaaattatcctaaatggtaatatattgtggataagtctgggcttattggacataatacatatttgggttggtactggttgaatccttcagttaactgctttgttgctttttgcaagattttttatcttaaacatgtcaggcatcttaagtcacctttatactgttttgttcctctgagtttctttcagtatgttatacaaatgccagacataacatgtagcagccatacttgcatggaaactgactacacatacataatactgcattttattgtaaggttttcacattaatacagcaattaccctgactaaattgagttttgtgatatatggaaaacttcattgtaagagaatcttgcatacaatgttgactattaacatccaaaataaagcatctgtgtacaag

The embodiments of the invention in which an exclusive property or privilege is claimed are defined as follows:

1. A method of inhibiting proliferation of a mammalian cell comprising:
    introducing into said cell an effective amount of small interfering RNA agents (iRNAs) that inhibit the expression of the miR-16 responsive genes represented by target sequences SEQ ID NOS:366, 368, 370, and 372;
    wherein each of the miR-16 responsive genes comprises a nucleotide sequence of at least six contiguous nucleotides that is complementary to at least six contiguous nucleotides located within positions 1 to 12 of SEQ ID NO:3; and
    wherein each of the iRNAs is at least 15 nucleotides in length and comprises a gene specific a nucleotide sequence that is substantially identical to the complement of a portion of an mRNA encoded by a target miR-16 responsive gene as represented by a gene target sequence selected from SEQ ID NOS:366, 368, 370, and 372.

2. The method of claim 1, wherein the at least six contiguous nucleotides located within positions 1 to 12 of SEQ ID NO:3 are identical to at least six contiguous nucleotides located within positions 1 to 12 of SEQ ID NO:1.

3. The method of claim 1, wherein the at least six contiguous nucleotides located within positions 1 to 12 of SEQ ID NO:3 are identical to at least six contiguous nucleotides located within positions 1 to 12 of SEQ ID NO:2.

4. The method of claim 1, wherein the at least six contiguous nucleotides located within positions 1 to 12 of SEQ ID NO:3 are identical to at least six contiguous nucleotides located within positions 1 to 12 of SEQ ID NO:4.

5. The method of claim 1, wherein the at least six contiguous nucleotides located within positions 1 to 12 of SEQ ID NO:3 are identical to at least six contiguous nucleotides located within positions 1 to 12 of SEQ ID NO:5.

6. The method of claim 1, wherein the at least six contiguous nucleotides located within positions 1 to 12 of SEQ ID NO:3 are identical to at least six contiguous nucleotides located within positions 1 to 12 of SEQ ID NO:6.

7. The method of claim 1, wherein the at least six contiguous nucleotides located within positions 1 to 12 of SEQ ID NO:3 are identical to at least six contiguous nucleotides located within positions 1 to 12 of SEQ ID NO:7.

8. The method of claim 1, wherein the target miR-16 responsive gene comprises a nucleotide sequence that is complementary to eight contiguous nucleotides located within SEQ ID NO:3.

9. The method of claim 1, wherein the mammalian cell is a cancer cell.

10. The method of claim 1, wherein the mammalian cell is infected with a virus expressing a micro RNA species in the miR-16 family.

11. The method of claim 10, wherein the mammalian cell is infected with kshv-miR-K12-6-5p.

12. The method of claim 1, wherein at least one of the iRNA agents comprises at least one chemically modified nucleotide or non-nucleotide.

13. The method of claim 1, wherein at least one of the iRNA agents comprises a dsRNA molecule comprising one nucleotide strand that is substantially identical to a portion of the mRNA encoded by at least one of the genes represented by a target sequence selected from SEQ ID NOS:366, 368, 370, and 372.

14. The method of claim 1, wherein at least one of the iRNA agents comprises a ssRNA molecule comprising one nucleotide strand that is substantially complementary to a portion of the mRNA encoded by at least one of the genes represented by a target sequence selected from SEQ ID NOS: 366, 368, 370, and 372.

15. The method of claim 1, wherein at least one of the iRNA agents is at least one dsRNA molecule comprising a double-stranded region, wherein one strand of the double-stranded region is substantially identical to 15 to 25 consecutive nucleotides encoded by a gene represented by a target sequence selected from SEQ ID NOS:366, 368, 370, and 372 and the second strand is substantially complementary to the first, and wherein at least one end of the dsRNA has an overhang of 1 to 4 nucleotides.

16. The method of claim 1, wherein at least one of the iRNA agents comprises at least one dsRNA molecule comprising at least one of SEQ ID NO:272-277, SEQ NO:284-289, SEQ ID NO:290-295, SEQ ID NO:248-253, SEQ ID NO:344-349, SEQ ID NO:350-355, SEQ ID NO:356-361.

17. The method of claim 9, wherein the cancer cell is an miR-16 mediated cancer cell.

18. The method of claim 1, wherein at least one of the miR-16 responsive genes further comprises a nucleotide sequence of at least six contiguous nucleotides that is complementary to at least six contiguous nucleotides located within positions 1 to 12 of SEQ ID NO: 1, wherein position 1 represents the 5' end of SEQ ID NO: 1.

19. The method of claim 1, wherein at least one of the miR-16 responsive genes further comprises a nucleotide sequence of at least six contiguous nucleotides that is complementary to at least six contiguous nucleotides located within positions 1 to 12 of SEQ ID NO: 2, wherein position 1 represents the 5' end of SEQ ID NO:2.

20. The method of claim 1, wherein at least one of the miR-16 responsive genes further comprises a nucleotide sequence of at least six contiguous nucleotides that is complementary to at least six contiguous nucleotides located within positions 1 to 12 of SEQ ID NO:4, wherein position 1 represents the 5' end of SEQ ID NO:4.

21. The method of claim 1, wherein at least one of the miR-16 responsive genes further comprises a nucleotide sequence of at least six contiguous nucleotides that is complementary to at least six contiguous nucleotides located within positions 1 to 12 of SEQ ID NO:5, wherein position 1 represents the 5' end of SEQ ID NO:5.

22. The method of claim 1, wherein at least one of the miR-16 responsive genes further comprises a nucleotide sequence of at least six contiguous nucleotides that is complementary to at least six contiguous nucleotides located within positions 1 to 12 of SEQ ID NO:6, wherein position 1 represents the 5' end of SEQ ID NO:6.

23. The method of claim 1, wherein at least one of the miR-16 responsive genes further comprises a nucleotide sequence of at least six contiguous nucleotides that is complementary to at least six contiguous nucleotides located within positions 1 to 12 of SEQ ID NO:7, wherein position 1 represents the 5' end of SEQ ID NO:7.

* * * * *